(12) United States Patent
Bowen et al.

(10) Patent No.: US 11,859,181 B2
(45) Date of Patent: Jan. 2, 2024

(54) RNA-GUIDED NUCLEASES AND ACTIVE FRAGMENTS AND VARIANTS THEREOF AND METHODS OF USE

(71) Applicant: LifeEDIT Therapeutics, Inc., Morrisville, NC (US)

(72) Inventors: Tyson D. Bowen, Morrisville, NC (US); Michael Coyle, Chapel Hill, NC (US); Alexandra Briner Crawley, Cary, NC (US); Tedd D. Elich, Durham, NC (US)

(73) Assignee: LIFEEDIT THERAPEUTICS, INC., Durham, NC (US)

( * ) Notice: Subject to any disclaimer, the term of this patent is extended or adjusted under 35 U.S.C. 154(b) by 24 days.

(21) Appl. No.: 17/823,897

(22) Filed: Aug. 31, 2022

(65) Prior Publication Data

US 2023/0257742 A1 Aug. 17, 2023

Related U.S. Application Data

(63) Continuation of application No. 17/851,887, filed on Jun. 28, 2022, which is a continuation of application No. PCT/US2021/028843, filed on Apr. 23, 2021.

(60) Provisional application No. 63/077,211, filed on Sep. 11, 2020, provisional application No. 63/014,970, filed on Apr. 24, 2020.

(51) Int. Cl.
| | |
|---|---|
| *C12N 15/85* | (2006.01) |
| *C12N 15/113* | (2010.01) |
| *C12N 15/66* | (2006.01) |
| *C12N 15/90* | (2006.01) |
| *C12N 15/64* | (2006.01) |
| *C12N 9/22* | (2006.01) |

(52) U.S. Cl.
CPC ............ *C12N 15/113* (2013.01); *C12N 9/22* (2013.01); *C12N 15/64* (2013.01); *C12N 15/66* (2013.01); *C12N 15/902* (2013.01); *C12N 2310/20* (2017.05); *C12Q 2521/301* (2013.01)

(58) Field of Classification Search
None
See application file for complete search history.

(56) References Cited

U.S. PATENT DOCUMENTS

| | | | |
|---|---|---|---|
| 11,578,323 B2 * | 2/2023 | Cohnen | ................ C12N 15/113 |
| 2019/0264232 A1 | 8/2019 | Hou et al. | |

FOREIGN PATENT DOCUMENTS

| | | |
|---|---|---|
| CN | 110 551 762 A | 12/2019 |
| WO | WO 2016/186946 A1 | 11/2016 |
| WO | WO 2018/007980 A1 | 1/2018 |
| WO | WO 2018/172556 A1 | 9/2018 |
| WO | WO 2019/195379 A1 | 10/2019 |
| WO | WO 2019/236566 A1 | 12/2019 |
| WO | WO 2020/139783 A2 | 7/2020 |
| WO | WO 2021/030344 A1 | 2/2021 |

OTHER PUBLICATIONS

Wentao, D., et al., "Development and Application of CRISPR/Cas in Microbial Biotechnology," *Frontier in Bioengineering and Biotechnology*, 2020, vol. 8(711), pp. 1-22.

\* cited by examiner

*Primary Examiner* — Marcia S Noble
(74) *Attorney, Agent, or Firm* — Womble Bond Dickinson (US) LLP

(57) ABSTRACT

Compositions and methods for binding to a target sequence of interest are provided. The compositions find use in cleaving or modifying a target sequence of interest, visualization of a target sequence of interest, and modifying the expression of a sequence of interest. Compositions comprise RNA-guided nuclease (RGN) polypeptides, CRISPR RNAs, trans-activating CRISPR RNAs, guide RNAs, and nucleic acid molecules encoding the same. Vectors and host cells comprising the nucleic acid molecules are also provided. Further provided are RGN systems for binding a target sequence of interest, wherein the RGN system comprises an RNA-guided nuclease polypeptide and one or more guide RNAs.

18 Claims, No Drawings
Specification includes a Sequence Listing.

RNA-GUIDED NUCLEASES AND ACTIVE FRAGMENTS AND VARIANTS THEREOF AND METHODS OF USE

CROSS-REFERENCE TO RELATED APPLICATIONS

This application is a continuation of U.S. application Ser. No. 17/851,887 filed Jun. 28, 2022, which is a continuation of International Application No. PCT/US2021/028843, filed Apr. 23, 2021, which claims priority to U.S. Provisional Application No. 63/014,970 filed Apr. 24, 2020, and U.S. Provisional Application No. 63/077,211, filed Sep. 11, 2020, each of which application is incorporated by reference herein in its entirety.

REFERENCE TO A SEQUENCE LISTING SUBMITTED AS AN XML FILE

The application contains a Sequence Listing which is submitted herewith in electronically readable format. The Sequence Listing created on Aug. 31, 2022, is named L103438_1200US_SL.xml and its size is 1.52 MB. The entire contents of the Sequence Listing are hereby incorporated by reference.

FIELD OF THE INVENTION

The present invention relates to the field of molecular biology and gene editing.

BACKGROUND OF THE INVENTION

Targeted genome editing or modification is rapidly becoming an important tool for basic and applied research. Initial methods involved engineering nucleases such as meganucleases, zinc finger fusion proteins or TALENs, requiring the generation of chimeric nucleases with engineered, programmable, sequence-specific DNA-binding domains specific for each particular target sequence. RNA-guided nucleases, such as the Clustered Regularly Interspaced Short Palindromic Repeats (CRISPR)-associated (Cas) proteins of the CRISPR-Cas bacterial system, allow for the targeting of specific sequences by complexing the nucleases with guide RNA that specifically hybridizes with a particular target sequence. Producing target-specific guide RNAs is less costly and more efficient than generating chimeric nucleases for each target sequence. Such RNA-guided nucleases can be used to edit genomes optionally through the introduction of a sequence-specific, double-stranded break that is repaired via error-prone non-homologous end-joining (NHEJ) to introduce a mutation at a specific genomic location. Alternatively, heterologous DNA may be introduced into the genomic site via homology-directed repair. RNA-guided nucleases (RGNs) can also be used for base editing when fused with a deaminase.

BRIEF SUMMARY OF THE INVENTION

Compositions and methods for binding a target sequence of interest are provided. The compositions find use in cleaving or modifying a target sequence of interest, detection of a target sequence of interest, and modifying the expression of a sequence of interest. Compositions comprise RNA-guided nuclease (RGN) polypeptides, CRISPR RNAs (crRNAs), trans-activating CRISPR RNAs (tracrRNAs), guide RNAs (gRNAs), nucleic acid molecules encoding the same, and vectors and host cells comprising the nucleic acid molecules. Also provided are RGN systems for binding a target sequence of interest, wherein the RGN system comprises an RNA-guided nuclease polypeptide and one or more guide RNAs. Thus, methods disclosed herein are drawn to binding a target sequence of interest, and in some embodiments, cleaving or modifying the target sequence of interest. The target sequence of interest can be modified, for example, as a result of non-homologous end joining, homology-directed repair with an introduced donor sequence, or base editing.

DETAILED DESCRIPTION

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended embodiments. Although specific terms are employed herein, they are used in a generic and descriptive sense only and not for purposes of limitation.

I. Overview

RGN-guided nucleases (RGNs) allow for the targeted manipulation of specific site(s) within a genome and are useful in the context of gene targeting for therapeutic and research applications. In a variety of organisms, including mammals, RNA-guided nucleases have been used for genome engineering by stimulating non-homologous end joining and homologous recombination, for example. The compositions and methods described herein are useful for creating single- or double-stranded breaks in polynucleotides, modifying polynucleotides, detecting a particular site within a polynucleotide, or modifying the expression of a particular gene.

The RNA-guided nucleases disclosed herein can alter gene expression by modifying a target sequence. In specific embodiments, the RNA-guided nucleases are directed to the target sequence by a guide RNA (gRNA) as part of a Clustered Regularly Interspaced Short Palindromic Repeats (CRISPR) RNA-guided nuclease system. The RGNs are considered "RNA-guided" because guide RNAs form a complex with the RNA-guided nucleases to direct the RNA-guided nuclease to bind to a target sequence and in some embodiments, introduce a single-stranded or double-stranded break at the target sequence. After the target sequence has been cleaved, the break can be repaired such that the DNA sequence of the target sequence is modified during the repair process. Thus, provided herein are methods for using the RNA-guided nucleases to modify a target sequence in the DNA of host cells. For example, RNA-guided nucleases can be used to modify a target sequence at a genomic locus of eukaryotic cells or prokaryotic cells.

II. RNA-Guided Nucleases

Provided herein are RNA-guided nucleases. The term RNA-guided nuclease (RGN) refers to a polypeptide that binds to a particular target nucleotide sequence in a sequence-specific manner and is directed to the target nucleotide sequence by a guide RNA molecule that is complexed with the polypeptide and hybridizes with the target sequence. Although an RNA-guided nuclease can be capable of cleaving the target sequence upon binding, the term RNA-guided nuclease also encompasses nuclease-dead RNA-guided nucleases that are capable of binding to, but not cleaving, a target sequence. Cleavage of a target sequence by an RNA-guided nuclease can result in a single- or double-stranded break. RNA-guided nucleases only capable of cleaving a single strand of a double-stranded nucleic acid molecule are referred to herein as nickases.

The RNA-guided nucleases disclosed herein include the APG06622, APG02787, APG06248, APG06007, APG02874, APG03850, APG07553, APG03031, APG09208, APG05586, APG08770, APG08167, APG01604, APG03021, APG06015, APG09344, APG07991, APG01868, APG02998, APG09298, APG06251, APG03066, APG01560, APG02777, APG05761, APG02479, APG08385, APG09217, and APG06657 RNA-guided nucleases, the amino acid sequences of which are set forth, respectively, as SEQ ID NOs: 1, 8, 15, 22, 29, 36, 43, 50, 56, 63, 70, 76, 83, 89, 96, 103, 110, 117, 123, and 570-579, and active fragments or variants thereof that retain the ability to bind to a target nucleotide sequence in an RNA-guided sequence-specific manner. In some of these embodiments, the active fragment or variant of the APG06622, APG02787, APG06248, APG06007, APG02874, APG03850, APG07553, APG03031, APG09208, APG05586, APG08770, APG08167, APG01604, APG03021, APG06015, APG09344, APG07991, APG01868, APG02998, APG09298, APG06251, APG03066, APG01560, APG02777, APG05761, APG02479, APG08385, APG09217, or APG06657 RGN is capable of cleaving a single- or double-stranded target sequence. In some embodiments, an active variant of the APG06622, APG02787, APG06248, APG06007, APG02874, APG03850, APG07553, APG03031, APG09208, APG05586, APG08770, APG08167, APG01604, APG03021, APG06015, APG09344, APG07991, APG01868, APG02998, APG09298, APG06251, APG03066, APG01560, APG02777, APG05761, APG02479, APG08385, APG09217, or APG06657 RGN comprises an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence set forth as SEQ ID NOs: 1, 8, 15, 22, 29, 36, 43, 50, 56, 63, 70, 76, 83, 89, 96, 103, 110, 117, 123, or 570-579. In certain embodiments, an active fragment of the APG06622, APG02787, APG06248, APG06007, APG02874, APG03850, APG07553, APG03031, APG09208, APG05586, APG08770, APG08167, APG01604, APG03021, APG06015, APG09344, APG07991, APG01868, APG02998, APG09298, APG06251, APG03066, APG01560, APG02777, APG05761, APG02479, APG08385, APG09217, or APG06657 RGN comprises at least 50, 100, 150, 200, 250, 300, 350, 400, 450, 500, 550, 600, 650, 700, 750, 800, 850, 900, 950, 1000, 1050 or more contiguous amino acid residues of the amino acid sequence set forth as SEQ ID NOs: 1, 8, 15, 22, 29, 36, 43, 50, 56, 63, 70, 76, 83, 89, 96, 103, 110, 117, 123, or 570-579. RNA-guided nucleases provided herein can comprise at least one nuclease domain (e.g., DNase, RNase domain) and at least one RNA recognition and/or RNA binding domain to interact with guide RNAs. Further domains that can be found in RNA-guided nucleases provided herein include, but are not limited to: DNA binding domains, helicase domains, protein-protein interaction domains, and dimerization domains. In specific embodiments, the RNA-guided nucleases provided herein can comprise at least 70%, 75%, 80%, 85%, 90%, 91%, 92%, 93%, 94%, 95%, 96%, 97%, 98%, 99% or more sequence identity to one or more of a DNA binding domain, helicase domain, protein-protein interaction domain, and dimerization domain.

A target nucleotide sequence is bound by an RNA-guided nuclease provided herein and hybridizes with the guide RNA associated with the RNA-guided nuclease. The target sequence can then be subsequently cleaved by the RNA-guided nuclease if the polypeptide possesses nuclease activity. The terms "cleave" or "cleavage" refer to the hydrolysis of at least one phosphodiester bond within the backbone of a target nucleotide sequence that can result in either single-stranded or double-stranded breaks within the target sequence. The presently disclosed RGNs can cleave nucleotides within a polynucleotide, functioning as an endonuclease or can be an exonuclease, removing successive nucleotides from the end (the 5' and/or the 3' end) of a polynucleotide. In other embodiments, the disclosed RGNs can cleave nucleotides of a target sequence within any position of a polynucleotide and thus function as both an endonuclease and exonuclease. The cleavage of a target polynucleotide by the presently disclosed RGNs can result in staggered breaks or blunt ends.

The presently disclosed RNA-guided nucleases can be wild-type sequences derived from bacterial or archaeal species. Alternatively, the RNA-guided nucleases can be variants or fragments of wild-type polypeptides. The wild-type RGN can be modified to alter nuclease activity or alter PAM specificity, for example. In some embodiments, the RNA-guided nuclease is not naturally-occurring.

In certain embodiments, the RNA-guided nuclease functions as a nickase, only cleaving a single strand of the target nucleotide sequence. Such RNA-guided nucleases have a single functioning nuclease domain. In particular embodiments, the nickase is capable of cleaving the positive strand or negative strand. In some of these embodiments, additional nuclease domains have been mutated such that the nuclease activity is reduced or eliminated.

In other embodiments, the RNA-guided nuclease lacks nuclease activity altogether and is referred to herein as nuclease-dead or nuclease inactive. Any method known in the art for introducing mutations into an amino acid sequence, such as PCR-mediated mutagenesis and site-directed mutagenesis, can be used for generating nickases or nuclease-dead RGNs. See, e.g., U.S. Publ. No. 2014/0068797 and U.S. Pat. No. 9,790,490; each of which is incorporated by reference in its entirety.

RNA-guided nucleases that lack nuclease activity can be used to deliver a fused polypeptide, polynucleotide, or small molecule payload to a particular genomic location. In some of these embodiments, the RGN polypeptide or guide RNA can be fused to a detectable label to allow for detection of a particular sequence. As a non-limiting example, a nuclease-dead RGN can be fused to a detectable label (e.g., fluorescent protein) and targeted to a particular sequence associated with a disease to allow for detection of the disease-associated sequence.

Alternatively, nuclease-dead RGNs can be targeted to particular genomic locations to alter the expression of a desired sequence. In some embodiments, the binding of a nuclease-dead RNA-guided nuclease to a target sequence results in the reduction in expression of the target sequence or a gene under transcriptional control by the target sequence by interfering with the binding of RNA polymerase or transcription factors within the targeted genomic region. In other embodiments, the RGN (e.g., a nuclease-dead RGN) or its complexed guide RNA further comprises an expression modulator that, upon binding to a target sequence, serves to either repress or activate the expression of the target sequence or a gene under transcriptional control by the target sequence. In some of these embodiments, the expression modulator modulates the expression of the target sequence or regulated gene through epigenetic mechanisms.

In other embodiments, the nuclease-dead RGNs or an RGN with only nickase activity can be targeted to particular genomic locations to modify the sequence of a target polynucleotide through fusion to a base-editing polypeptide, for example a deaminase polypeptide or active variant or fragment thereof, that directly chemically modifies (e.g., deaminates) a nucleobase, resulting in conversion from one nucleotide base to another. The base-editing polypeptide can be fused to the RGN at its N-terminal or C-terminal end. Additionally, the base-editing polypeptide may be fused to the RGN via a peptide linker. A non-limiting example of a deaminase polypeptide that is useful for such compositions and methods includes a cytidine deaminase or an adenosine deaminase (such as the adenine deaminase base editor described in Gaudelli et al. (2017) *Nature* 551:464-471, U.S. Publ. Nos. 2017/0121693 and 2018/0073012, and International Publ. No. WO 2018/027078, or any of the deaminases disclosed in International Publ. No. WO 2020/139873, and U.S. Provisional Appl. Nos. 63/077,089 filed Sep. 11, 2020, 63/146,840 filed Feb. 8, 2021, and 63/164,273 filed Mar. 22, 2021, each of which is herein incorporated by reference in its entirety). Further, it is known in the art that certain fusion proteins between an RGN and a base-editing enzyme may also comprise at least one uracil stabilizing polypeptide that increases the mutation rate of a cytidine, deoxycytidine, or cytosine to a thymidine, deoxythymidine, or thymine in a nucleic acid molecule by a deaminase. Non-limiting examples of uracil stabilizing polypeptides include those disclosed in U.S. Provisional Appl. No. 63/052,175, filed Jul. 15, 2020, including USP2 (SEQ ID NO: 1089), and a uracil glycosylase inhibitor (UGI) domain (SEQ ID NO: 212), which may increase base editing efficiency. Therefore, a fusion protein may comprise an RGN described herein or variant thereof, a deaminase, and optionally at least one uracil stabilizing polypeptide, such as UGI or USP2. In certain embodiments, the RGN that is fused to the base-editing polypeptide is a nickase that cleaves the DNA strand that is not acted upon by the base-editing polypeptide (e.g., deaminase).

RNA-guided nucleases that are fused to a polypeptide or domain can be separated or joined by a linker. The term "linker," as used herein, refers to a chemical group or a molecule linking two molecules or moieties, e.g., a binding domain and a cleavage domain of a nuclease. In some embodiments, a linker joins a gRNA binding domain of an RNA guided nuclease and a base-editing polypeptide, such as a deaminase. In some embodiments, a linker joins a nuclease-dead RGN and a deaminase. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The presently disclosed RNA-guided nucleases can comprise at least one nuclear localization signal (NLS) to enhance transport of the RGN to the nucleus of a cell. Nuclear localization signals are known in the art and generally comprise a stretch of basic amino acids (see, e.g., Lange et al., *J. Biol. Chem.* (2007) 282:5101-5105). In particular embodiments, the RGN comprises 2, 3, 4, 5, 6 or more nuclear localization signals. The nuclear localization signal(s) can be a heterologous NLS. Non-limiting examples of nuclear localization signals useful for the presently disclosed RGNs are the nuclear localization signals of SV40 Large T-antigen, nucleoplasmin, and c-Myc (see, e.g., Ray et al. (2015) *Bioconjug Chem* 26(6):1004-7). In particular embodiments, the RGN comprises the NLS sequence set forth as SEQ ID NO: 251 or 253. The RGN can comprise one or more NLS sequences at its N-terminus, C-terminus, or both the N-terminus and C-terminus. For example, the RGN can comprise two NLS sequences at the N-terminal region and four NLS sequences at the C-terminal region.

Other localization signal sequences known in the art that localize polypeptides to particular subcellular location(s) can also be used to target the RGNs, including, but not limited to, plastid localization sequences, mitochondrial localization sequences, and dual-targeting signal sequences that target to both the plastid and mitochondria (see, e.g., Nassoury and Morse (2005) *Biochim Biophys Acta* 1743:5-19; Kunze and Berger (2015) *Front Physiol* dx.doi.org/10.3389/fphys.2015.00259; Herrmann and Neupert (2003) *IUBMB Life* 55:219-225; Soll (2002) *Curr Opin Plant Biol* 5:529-535; Carrie and Small (2013) *Biochim Biophys Acta* 1833:253-259; Carrie et al. (2009) *FEBS J* 276:1187-1195; Silva-Filho (2003) *Curr Opin Plant Biol* 6:589-595; Peeters and Small (2001) *Biochim Biophys Acta* 1541:54-63; Murcha et al. (2014) *J Exp Bot* 65:6301-6335; Mackenzie (2005) *Trends Cell Biol* 15:548-554; Glaser et al. (1998) *Plant Mol Biol* 38:311-338).

In certain embodiments, the presently disclosed RNA-guided nucleases comprise at least one cell-penetrating domain that facilitates cellular uptake of the RGN. Cell-penetrating domains are known in the art and generally comprise stretches of positively charged amino acid residues (i.e., polycationic cell-penetrating domains), alternating polar amino acid residues and non-polar amino acid residues (i.e., amphipathic cell-penetrating domains), or hydrophobic amino acid residues (i.e., hydrophobic cell-penetrating domains) (see, e.g., Milletti F. (2012) *Drug Discov Today* 17:850-860). A non-limiting example of a cell-penetrating domain is the trans-activating transcriptional activator (TAT) from the human immunodeficiency virus 1.

The nuclear localization signal, plastid localization signal, mitochondrial localization signal, dual-targeting localization signal, and/or cell-penetrating domain can be located at the amino-terminus (N-terminus), the carboxyl-terminus (C-terminus), or in an internal location of the RNA-guided nuclease.

The presently disclosed RGNs can be fused to an effector domain, such as a cleavage domain, a deaminase domain, or an expression modulator domain, either directly or indirectly via a linker peptide. Such a domain can be located at the N-terminus, the C-terminus, or an internal location of the RNA-guided nuclease. In some of these embodiments, the RGN component of the fusion protein is a nuclease-dead RGN.

In some embodiments, the RGN fusion protein comprises a cleavage domain, which is any domain that is capable of cleaving a polynucleotide (i.e., RNA, DNA, or RNA/DNA hybrid) and includes, but is not limited to, restriction endonucleases and homing endonucleases, such as Type IIS endonucleases (e.g., FokI) (see, e.g., Belfort et al. (1997)

*Nucleic Acids Res.* 25:3379-3388; Linn et al. (eds.) Nucleases, Cold Spring Harbor Laboratory Press, 1993).

In other embodiments, the RGN fusion protein comprises a deaminase domain that deaminates a nucleobase, resulting in conversion from one nucleobase to another, and includes, but is not limited to, a cytidine deaminase or an adenine deaminase base editor (see, e.g., Gaudelli et al. (2017) *Nature* 551:464-471, U.S. Publ. Nos. 2017/0121693 and 2018/0073012, U.S. Pat. No. 9,840,699, and International Publ. No. WO/2018/027078).

In some embodiments, the effector domain of the RGN fusion protein can be an expression modulator domain, which is a domain that either serves to upregulate or downregulate transcription. The expression modulator domain can be an epigenetic modification domain, a transcriptional repressor domain or a transcriptional activation domain.

In some of these embodiments, the expression modulator of the RGN fusion protein comprises an epigenetic modification domain that covalently modifies DNA or histone proteins to alter histone structure and/or chromosomal structure without altering the DNA sequence, leading to changes in gene expression (i.e., upregulation or downregulation). Non-limiting examples of epigenetic modifications include acetylation or methylation of lysine residues, arginine methylation, serine and threonine phosphorylation, and lysine ubiquitination and sumoylation of histone proteins, and methylation and hydroxymethylation of cytosine residues in DNA. Non-limiting examples of epigenetic modification domains include histone acetyltransferase domains, histone deacetylase domains, histone methyltransferase domains, histone demethylase domains, DNA methyltransferase domains, and DNA demethylase domains.

In other embodiments, the expression modulator of the fusion protein comprises a transcriptional repressor domain, which interacts with transcriptional control elements and/or transcriptional regulatory proteins, such as RNA polymerases and transcription factors, to reduce or terminate transcription of at least one gene. Transcriptional repressor domains are known in the art and include, but are not limited to, Sp1-like repressors, IκB, and Krüppel associated box (KRAB) domains.

In yet other embodiments, the expression modulator of the fusion protein comprises a transcriptional activation domain, which interacts with transcriptional control elements and/or transcriptional regulatory proteins, such as RNA polymerases and transcription factors, to increase or activate transcription of at least one gene. Transcriptional activation domains are known in the art and include, but are not limited to, a herpes simplex virus VP16 activation domain and an NFAT activation domain.

The presently disclosed RGN polypeptides can comprise a detectable label or a purification tag. The detectable label or purification tag can be located at the N-terminus, the C-terminus, or an internal location of the RNA-guided nuclease, either directly or indirectly via a linker peptide. In some of these embodiments, the RGN component of the fusion protein is a nuclease-dead RGN. In other embodiments, the RGN component of the fusion protein is an RGN with nickase activity.

A detectable label is a molecule that can be visualized or otherwise observed. The detectable label may be fused to the RGN as a fusion protein (e.g., fluorescent protein) or may be a small molecule conjugated to the RGN polypeptide that can be detected visually or by other means. Detectable labels that can be fused to the presently disclosed RGNs as a fusion protein include any detectable protein domain, including but not limited to, a fluorescent protein or a protein domain that can be detected with a specific antibody. Non-limiting examples of fluorescent proteins include green fluorescent proteins (e.g., GFP, EGFP, ZsGreen1) and yellow fluorescent proteins (e.g., YFP, EYFP, ZsYellow1). Non-limiting examples of small molecule detectable labels include radioactive labels, such as $^3$H and $^{35}$S.

RGN polypeptides can also comprise a purification tag, which is any molecule that can be utilized to isolate a protein or fused protein from a mixture (e.g., biological sample, culture medium). Non-limiting examples of purification tags include biotin, myc, maltose binding protein (MBP), glutathione-S-transferase (GST), and 3×FLAG tag.

II. Guide RNA

The present disclosure provides guide RNAs and polynucleotides encoding the same. The term "guide RNA" refers to a nucleotide sequence having sufficient complementarity with a target nucleotide sequence to hybridize with the target sequence and direct sequence-specific binding of an associated RNA-guided nuclease to the target nucleotide sequence. Thus, an RGN's respective guide RNA is one or more RNA molecules (generally, one or two), that can bind to the RGN and guide the RGN to bind to a particular target nucleotide sequence, and in those embodiments wherein the RGN has nickase or nuclease activity, also cleave the target nucleotide sequence. In general, a guide RNA comprises a CRISPR RNA (crRNA) and a trans-activating CRISPR RNA (tracrRNA). Native guide RNAs that comprise both a crRNA and a tracrRNA generally comprise two separate RNA molecules that hybridize to each other through the repeat sequence of the crRNA and the anti-repeat sequence of the tracrRNA.

Native direct repeat sequences within a CRISPR array generally range in length from 28 to 37 base pairs, although the length can vary between about 23 bp to about 55 bp. Spacer sequences within a CRISPR array generally range from about 32 to about 38 bp in length, although the length can be between about 21 bp to about 72 bp. Each CRISPR array generally comprises less than 50 units of the CRISPR repeat-spacer sequence. The CRISPRs are transcribed as part of a long transcript termed the primary CRISPR transcript, which comprises much of the CRISPR array. The primary CRISPR transcript is cleaved by Cas proteins to produce crRNAs or in some cases, to produce pre-crRNAs that are further processed by additional Cas proteins into mature crRNAs. Mature crRNAs comprise a spacer sequence and a CRISPR repeat sequence. In some embodiments in which pre-crRNAs are processed into mature (or processed) crRNAs, maturation involves the removal of about one to about six or more 5', 3', or 5' and 3' nucleotides. For the purposes of genome editing or targeting a particular target nucleotide sequence of interest, these nucleotides that are removed during maturation of the pre-crRNA molecule are not necessary for generating or designing a guide RNA.

A CRISPR RNA (crRNA) comprises a spacer sequence and a CRISPR repeat sequence. The "spacer sequence" is the nucleotide sequence that directly hybridizes with the target nucleotide sequence of interest. The spacer sequence is engineered to be fully or partially complementary with the target sequence of interest. In various embodiments, the spacer sequence can comprise from about 8 nucleotides to about 30 nucleotides, or more. For example, the spacer sequence can be about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In some embodiments, the spacer sequence is 8, 9, 10, 11, 12, 13, 14, 15, 16, 17, 18, 19, 20, 21, 22, 23, 24, 25, 26, 27, 28, 29, 30, or more nucleotides in length. In some embodiments, the spacer sequence is about 10 to about 26 nucleotides in length, or about 12 to about 30 nucleotides in length. In particular embodiments, the spacer sequence is about 30 nucleotides in length. In some embodiments, the spacer sequence is 30 nucleotides in length. In some embodiments, the degree of complementarity between a spacer sequence and its corresponding target sequence, when optimally aligned using a suitable alignment algorithm, is between 50% and 99% or more, including but not limited to about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more. In particular embodiments, the degree of complementarity between a spacer sequence and its corresponding target sequence, when optimally aligned using a suitable alignment algorithm, is 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more. In particular embodiments, the spacer sequence is free of secondary structure, which can be predicted using any suitable polynucleotide folding algorithm known in the art, including but not limited to mFold (see, e.g., Zuker and Stiegler (1981) *Nucleic Acids Res.* 9:133-148) and RNAfold (see, e.g., Gruber et al. (2008) *Cell* 106(1):23-24).

The CRISPR RNA repeat sequence comprises a nucleotide sequence that forms a structure, either on its own or in concert with a hybridized tracrRNA, that is recognized by the RGN molecule. In various embodiments, the CRISPR RNA repeat sequence can comprise from about 8 nucleotides to about 30 nucleotides, or more. For example, the CRISPR repeat sequence can be about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In particular embodiments, the CRISPR repeat sequence is 8, 9, 10, 11, 12, 13, 14, 15, 16, 17, 18, 19, 20, 21, 22, 23, 24, 25, 26, 27, 28, 29, 30, or more nucleotides in length. In some embodiments, the degree of complementarity between a CRISPR repeat sequence and its corresponding tracrRNA sequence, when optimally aligned using a suitable alignment algorithm, is about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more. In particular embodiments, the degree of complementarity between a CRISPR repeat sequence and its corresponding tracrRNA sequence, when optimally aligned using a suitable alignment algorithm, is 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more.

In particular embodiments, the CRISPR repeat sequence comprises the nucleotide sequence of SEQ ID NOs: 2, 9, 16, 23, 30, 37, 44, 51, 57, 64, 71, 77, 84, 90, 97, 104, 111, 118, or 124, or an active variant or fragment thereof that when comprised within a guide RNA, is capable of directing the sequence-specific binding of an associated RNA-guided nuclease provided herein to a target sequence of interest. In certain embodiments, an active CRISPR repeat sequence variant of a wild-type sequence comprises a nucleotide sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to the nucleotide sequence set forth as SEQ ID NOs: 2, 9, 16, 23, 30, 37, 44, 51, 57, 64, 71, 77, 84, 90, 97, 104, 111, 118, or 124. In certain embodiments, an active CRISPR repeat sequence fragment of a wild-type sequence comprises at least 5, 6, 7, 8, 9, 10, 11, 12, 13, 14, 15, 16, 17, 18, 19, 20, 21, or 22 contiguous nucleotides of the nucleotide sequence set forth as SEQ ID NOs: 2, 9, 16, 23, 30, 37, 44, 51, 57, 64, 71, 77, 84, 90, 97, 104, 111, 118, or 124.

In certain embodiments, the crRNA is not naturally-occurring. In some of these embodiments, the specific CRISPR repeat sequence is not linked to the engineered spacer sequence in nature and the CRISPR repeat sequence is considered heterologous to the spacer sequence. In certain embodiments, the spacer sequence is an engineered sequence that is not naturally occurring.

A trans-activating CRISPR RNA or tracrRNA molecule comprises a nucleotide sequence comprising a region that has sufficient complementarity to hybridize to a CRISPR repeat sequence of a crRNA, which is referred to herein as the anti-repeat region. In some embodiments, the tracrRNA molecule further comprises a region with secondary structure (e.g., stem-loop) or forms secondary structure upon hybridizing with its corresponding crRNA. In particular embodiments, the region of the tracrRNA that is fully or partially complementary to a CRISPR repeat sequence is at the 5' end of the molecule and the 3' end of the tracrRNA comprises secondary structure. This region of secondary structure generally comprises several hairpin structures, including the nexus hairpin, which is found adjacent to the anti-repeat sequence. The nexus forms the core of the interactions between the guide RNA and the RGN, and is at the intersection between the guide RNA, the RGN, and the target DNA. The nexus hairpin often has a conserved nucleotide sequence in the base of the hairpin stem, with the motif UNANNC (SEQ ID NO: 132) found in many nexus hairpins in tracrRNAs. Interestingly, several of the RGNS of the invention use tracrRNAs that comprise non-canonical sequences in the base of the hairpin stem of their nexus hairpins, including UNANNA, UNANNU, UNANNG, and CNANNC (SEQ ID NOs: 129, 130, 131, and 133, respectively). There are often terminal hairpins at the 3' end of the tracrRNA that can vary in structure and number, but often comprise a GC-rich Rho-independent transcriptional terminator hairpin followed by a string of U's at the 3' end. See, for example, Briner et al. (2014) *Molecular Cell* 56:333-339, Briner and Barrangou (2016) *Cold Spring Harb Protoc*; doi: 10.1101/pdb.top090902, and U.S. Publication No. 2017/0275648, each of which is herein incorporated by reference in its entirety.

In various embodiments, the anti-repeat region of the tracrRNA that is fully or partially complementary to the CRISPR repeat sequence comprises from about 8 nucleotides to about 30 nucleotides, or more. For example, the region of base pairing between the tracrRNA anti-repeat sequence and the CRISPR repeat sequence can be about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In particular embodiments, the region of base pairing between the tracrRNA anti-repeat sequence and the CRISPR repeat sequence is 6, 7, 8, 9, 10, 11, 12, 13, 14, 15, 16, 17, 18, 19, 20, 21, 22, 23, 24, 25, 26, 27, 28, 29, 30, or more nucleotides in length. In some embodiments, the degree of complementarity between a CRISPR repeat sequence and its corresponding tracrRNA anti-repeat sequence, when optimally aligned using a suitable alignment algorithm, is about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more. In particular embodiments, the degree of complementarity between a CRISPR repeat sequence and its corresponding tracrRNA anti-repeat sequence, when optimally aligned using a suitable alignment algorithm, is 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more.

In various embodiments, the entire tracrRNA can comprise from about 60 nucleotides to more than about 210 nucleotides. For example, the tracrRNA can be about 60, about 65, about 70, about 75, about 80, about 85, about 90, about 95, about 100, about 105, about 110, about 115, about 120, about 125, about 130, about 135, about 140, about 150, about 160, about 170, about 180, about 190, about 200, about 210, or more nucleotides in length. In particular embodiments, the tracrRNA is 60, 65, 70, 75, 80, 85, 90, 95, 100, 105, 110, 115, 120, 125, 130, 135, 140, 150, 160, 170, 180, 190, 200, 210 or more nucleotides in length. In particular embodiments, the tracrRNA is about 80 to about 90 nucleotides in length, including about 80, about 81, about 82, about 83, about 84, about 85, about 86, about 87, about 88, about 89, and about 90 nucleotides in length. In particular embodiments, the tracrRNA is 80 to 90 nucleotides in length, including 80, 81, 82, 83, 84, 85, 86, 87, 88, 89, and 90 nucleotides in length.

In particular embodiments, the tracrRNA comprises the nucleotide sequence of SEQ ID NOs: 3, 10, 17, 24, 31, 38, 45, 52, 58, 65, 72, 78, 85, 91, 98, 105, 112, 119, or 125, or an active variant or fragment thereof that when comprised within a guide RNA is capable of directing the sequence-specific binding of an associated RNA-guided nuclease provided herein to a target sequence of interest. In certain embodiments, an active tracrRNA sequence variant of a wild-type sequence comprises a nucleotide sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to the nucleotide sequence set forth as SEQ ID NOs: 3, 10, 17, 24, 31, 38, 45, 52, 58, 65, 72, 78, 85, 91, 98, 105, 112, 119, or 125. In certain embodiments, an active tracrRNA sequence fragment of a wild-type sequence comprises at least 5, 10, 15, 20, 25, 30, 35, 40, 45, 50, 55, 60, 65, 70, 75, 80, or more contiguous nucleotides of the nucleotide sequence set forth as SEQ ID NOs: 3, 10, 17, 24, 31, 38, 45, 52, 58, 65, 72, 78, 85, 91, 98, 105, 112, 119, or 125.

Two polynucleotide sequences can be considered to be substantially complementary when the two sequences hybridize to each other under stringent conditions. Likewise, an RGN is considered to bind to a particular target sequence within a sequence-specific manner if the guide RNA bound to the RGN binds to the target sequence under stringent conditions. By "stringent conditions" or "stringent hybridization conditions" is intended conditions under which the two polynucleotide sequences will hybridize to each other to a detectably greater degree than to other sequences (e.g., at least 2-fold over background). Stringent conditions are sequence-dependent and will be different in different circumstances. Typically, stringent conditions will be those in which the salt concentration is less than about 1.5 M Na ion, typically about 0.01 to 1.0 M Na ion concentration (or other salts) at pH 7.0 to 8.3, and the temperature is at least about 30° C. for short sequences (e.g., 10 to 50 nucleotides) and at least about 60° C. for long sequences (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The Tm is the temperature (under defined ionic strength and pH) at which 50% of a complementary target sequence hybridizes to a perfectly matched sequence. For DNA-DNA hybrids, the Tm can be approximated from the equation of Meinkoth and Wahl (1984) Anal. Biochem. 138:267-284: Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3, or 4° C. lower than the thermal melting point (Tm); moderately stringent conditions can utilize a hybridization and/or wash at 6, 7, 8, 9, or 10° C. lower than the thermal melting point (Tm); low stringency conditions can utilize a hybridization and/or wash at 11, 12, 13, 14, 15, or 20° C. lower than the thermal melting point (Tm). Using the equation, hybridization and wash compositions, and desired Tm, those of ordinary skill will understand that variations in the stringency of hybridization and/or wash solutions are inherently described. An extensive guide to the hybridization of nucleic acids is found in Tijssen (1993) Laboratory Techniques in Biochemistry and Molecular Biology—Hybridization with Nucleic Acid Probes, Part I, Chapter 2 (Elsevier, New York); and Ausubel et al., eds. (1995) Current Protocols in Molecular Biology, Chapter 2 (Greene Publishing and Wiley-Interscience, New York). See Sambrook et al. (1989) Molecular Cloning: A Laboratory Manual (2d ed., Cold Spring Harbor Laboratory Press, Plainview, New York).

The term "sequence specific" can also refer to the binding of a target sequence at a greater frequency than binding to a randomized background sequence.

The guide RNA can be a single guide RNA or a dual-guide RNA system. A single guide RNA comprises the crRNA and tracrRNA on a single molecule of RNA, whereas a dual-guide RNA system comprises a crRNA and a tracrRNA present on two distinct RNA molecules, hybridized to one another through at least a portion of the CRISPR repeat sequence of the crRNA and at least a portion of the tracrRNA, which may be fully or partially complementary to the CRISPR repeat sequence of the crRNA. In some of those embodiments wherein the guide RNA is a single guide RNA, the crRNA and tracrRNA are separated by a linker nucleotide sequence. In general, the linker nucleotide sequence is one that does not include complementary bases in order to avoid the formation of secondary structure within or comprising nucleotides of the linker nucleotide sequence. In some embodiments, the linker nucleotide sequence between the crRNA and tracrRNA is at least 3, at least 4, at least 5, at least 6, at least 7, at least 8, at least 9, at least 10, at least 11, at least 12, or more nucleotides in length. In particular embodiments, the linker nucleotide sequence of a single guide RNA is at least 4 nucleotides in length. In certain embodiments, the linker nucleotide sequence is the nucleotide sequence set forth as SEQ ID NO: 249.

The single guide RNA or dual-guide RNA can be synthesized chemically or via in vitro transcription. Assays for determining sequence-specific binding between an RGN and a guide RNA are known in the art and include, but are not limited to, in vitro binding assays between an expressed RGN and the guide RNA, which can be tagged with a detectable label (e.g., biotin) and used in a pull-down detection assay in which the guide RNA:RGN complex is captured via the detectable label (e.g., with streptavidin beads). A control guide RNA with an unrelated sequence or structure to the guide RNA can be used as a negative control for non-specific binding of the RGN to RNA. In certain embodiments, the guide RNA is SEQ ID NO: 4, 11, 18, 25, 32, 39, 46, 53, 59, 66, 73, 79, 86, 92, 99, 106, 113, 120, or 126, wherein the spacer sequence can be any sequence and is indicated as a poly-N sequence.

In certain embodiments, the guide RNA can be introduced into a target cell, organelle, or embryo as an RNA molecule. The guide RNA can be transcribed in vitro or chemically synthesized. In other embodiments, a nucleotide sequence encoding the guide RNA is introduced into the cell, organelle, or embryo. In some of these embodiments, the nucleotide sequence encoding the guide RNA is operably linked to a promoter (e.g., an RNA polymerase III promoter). The promoter can be a native promoter or heterologous to the guide RNA-encoding nucleotide sequence.

In various embodiments, the guide RNA can be introduced into a target cell, organelle, or embryo as a ribonucleoprotein complex, as described herein, wherein the guide RNA is bound to an RNA-guided nuclease polypeptide.

The guide RNA directs an associated RNA-guided nuclease to a particular target nucleotide sequence of interest through hybridization of the guide RNA to the target nucleotide sequence. A target nucleotide sequence can comprise DNA, RNA, or a combination of both and can be single-stranded or double-stranded. A target nucleotide sequence can be genomic DNA (i.e., chromosomal DNA), plasmid DNA, or an RNA molecule (e.g., messenger RNA, ribosomal RNA, transfer RNA, micro RNA, small interfering RNA). The target nucleotide sequence can be bound (and in some embodiments, cleaved) by an RNA-guided nuclease in vitro or in a cell. The chromosomal sequence targeted by the RGN can be a nuclear, plastid or mitochondrial chromosomal sequence. In some embodiments, the target nucleotide sequence is unique in the target genome.

The target nucleotide sequence is adjacent to a protospacer adjacent motif (PAM). A protospacer adjacent motif is generally within about 1 to about 10 nucleotides from the target nucleotide sequence, including about 1, about 2, about 3, about 4, about 5, about 6, about 7, about 8, about 9, or about 10 nucleotides from the target nucleotide sequence. In particular embodiments, a PAM is within 1 to 10 nucleotides from the target nucleotide sequence, including 1, 2, 3, 4, 5, 6, 7, 8, 9, or 10 nucleotides from the target nucleotide sequence. The PAM can be 5' or 3' of the target sequence. In some embodiments, the PAM is 3' of the target sequence for the presently disclosed RGNs. Generally, the PAM is a consensus sequence of about 3-4 nucleotides, but in particular embodiments it can be 2, 3, 4, 5, 6, 7, 8, 9, or more nucleotides in length. In various embodiments, the PAM sequence recognized by the presently disclosed RGNs comprises the consensus sequence set forth as SEQ ID NOs: 7, 14, 21, 28, 35, 42, 49, 62, 69, 79, 82, 95, 102, 109, or 116.

In particular embodiments, an RNA-guided nuclease having SEQ ID NOs: 1, 8, 15, 22, 29, 36, 43, 50, 56, 63, 70, 76, 83, 89, 96, 103, 110, 117, 123, or 570-579 or an active variant or fragment thereof binds a target nucleotide sequence adjacent to a PAM sequence set forth as SEQ ID NOs: 7, 14, 21, 28, 35, 42, 49, 62, 69, 79, 82, 95, 102, 109, or 116. In some of these embodiments, the RGN binds to a guide sequence comprising a CRISPR repeat sequence set forth in SEQ ID NOs: 2, 9, 16, 23, 30, 37, 44, 51, 57, 64, 71, 77, 84, 90, 97, 104, 111, 118, or 124, respectively, or an active variant or fragment thereof, and a tracrRNA sequence set forth in SEQ ID NOs: 3, 10, 17, 24, 31, 38, 45, 52, 58, 65, 72, 78, 85, 91, 98, 105, 112, 119, or 125, respectively, or an active variant or fragment thereof. The RGN systems are described further in Examples 1-3 and Tables 1 and 2 of the present specification.

Variants of RGN APG05586 (SEQ ID NO: 63) were produced and have amino acid sequences of SEQ ID NOs: 570-579. RGNs having any one of SEQ ID NOs: 63 and 570-579 can bind a target nucleotide sequence adjacent to a PAM sequence set forth as SEQ ID NO: 79. In some embodiments, the variants of RGN APG05586 bind to a guide sequence comprising a CRISPR repeat sequence set forth in SEQ ID NO: 64 and may also comprise a tracrRNA sequence set forth in SEQ ID NO: 65. These RGN systems are described further in Example 5 of the present specification.

It is well-known in the art that PAM sequence specificity for a given nuclease enzyme is affected by enzyme concentration (see, e.g., Karvelis et al. (2015) *Genome Biol* 16:253), which may be modified by altering the promoter used to express the RGN, or the amount of ribonucleoprotein complex delivered to the cell, organelle, or embryo.

Upon recognizing its corresponding PAM sequence, the RGN can cleave the target nucleotide sequence at a specific cleavage site. As used herein, a cleavage site is made up of the two particular nucleotides within a target nucleotide sequence between which the nucleotide sequence is cleaved by an RGN. The cleavage site can comprise the $1^{st}$ and $2^{nd}$, $2^{nd}$ and $3^{rd}$, $3^{rd}$ and $4^{th}$ $4^{th}$ and $5^{th}$ $5^{th}$ and $6^{th}$, $7^{th}$ and $8^{th}$, or $8^{th}$ and $9^{th}$ nucleotides from the PAM in either the 5' or 3' direction. In some embodiments, the cleavage site may be over 10, 11, 12, 13, 14, 15, 16, 17, 18, 19, or 20 nucleotides from the PAM in either the 5' or 3' direction. As RGNs can cleave a target nucleotide sequence resulting in staggered ends, in some embodiments, the cleavage site is defined based on the distance of the two nucleotides from the PAM on the positive (+) strand of the polynucleotide and the distance of the two nucleotides from the PAM on the negative (−) strand of the polynucleotide.

III. Nucleotides Encoding RNA-Guided Nucleases, CRISPR RNA, and/or tracrRNA

The present disclosure provides polynucleotides comprising the presently disclosed CRISPR RNAs, tracrRNAs, and/or sgRNAs and polynucleotides comprising a nucleotide sequence encoding the presently disclosed RNA-guided nucleases, CRISPR RNAs, tracrRNAs, and/or sgRNAs. Presently disclosed polynucleotides include those comprising or encoding a CRISPR repeat sequence comprising the nucleotide sequence of SEQ ID NOs: 2, 9, 16, 23, 30, 37, 44, 51, 57, 64, 71, 77, 84, 90, 97, 104, 111, 118, or 124, or an active variant or fragment thereof that when comprised within a guide RNA is capable of directing the sequence-specific binding of an associated RNA-guided nuclease to a target sequence of interest. Also disclosed are polynucleotides comprising or encoding a tracrRNA comprising the nucleotide sequence of SEQ ID NOs: 3, 10, 17, 24, 31, 38, 45, 52, 58, 65, 72, 78, 85, 91, 98, 105, 112, 119, or 125, or an active variant or fragment thereof that when comprised within a guide RNA is capable of directing the sequence-specific binding of an associated RNA-guided nuclease to a target sequence of interest. Polynucleotides are also provided that encode an RNA-guided nuclease comprising the amino acid sequence set forth as SEQ ID NOs: 1, 8, 15, 22, 29, 36, 43, 50, 56, 63, 70, 76, 83, 89, 96, 103, 110, 117, 123, or 570-579, and active fragments or variants thereof that retain the ability to bind to a target nucleotide sequence in an RNA-guided sequence-specific manner.

The use of the term "polynucleotide" or "nucleic acid molecule" is not intended to limit the present disclosure to polynucleotides comprising DNA. Those of ordinary skill in the art will recognize that polynucleotides can comprise ribonucleotides (RNA) and combinations of ribonucleotides and deoxyribonucleotides. Such deoxyribonucleotides and ribonucleotides include both naturally occurring molecules and synthetic analogues. These include peptide nucleic acids (PNAs), PNA-DNA chimers, locked nucleic acids (LNAs), and phosphothiorate linked sequences. The polynucleotides disclosed herein also encompass all forms of sequences including, but not limited to, single-stranded forms, double-stranded forms, DNA-RNA hybrids, triplex structures, stem-and-loop structures, and the like.

The nucleic acid molecules encoding RGNs can be codon optimized for expression in an organism of interest. A "codon-optimized" coding sequence is a polynucleotide coding sequence having its frequency of codon usage designed to mimic the frequency of preferred codon usage or transcription conditions of a particular host cell. Expression in the particular host cell or organism is enhanced as a result of the alteration of one or more codons at the nucleic acid level such that the translated amino acid sequence is not changed. Nucleic acid molecules can be codon optimized, either wholly or in part. Codon tables and other references providing preference information for a wide range of organisms are available in the art (see, e.g., Campbell and Gown (1990) *Plant Physiol.* 92:1-11 for a discussion of plant-preferred codon usage). Methods are available in the art for synthesizing plant-preferred genes or mammalian (for example human) codon-optimized coding sequences. See, for example, U.S. Pat. Nos. 5,380,831, and 5,436,391, and Murray et al. (1989) *Nucleic Acids Res.* 17:477-498, herein incorporated by reference.

Polynucleotides encoding the RGNs, crRNAs, tracrRNAs, and/or sgRNAs provided herein can be provided in expression cassettes for in vitro expression or expression in a cell, organelle, embryo, or organism of interest. The cassette will include 5' and 3' regulatory sequences operably linked to a polynucleotide encoding an RGN, crRNA, tracrRNAs, and/or sgRNAs provided herein that allows for expression of the polynucleotide. The cassette may additionally contain at least one additional gene or genetic element to be cotransformed into the organism. Where additional genes or elements are included, the components are operably linked. The term "operably linked" is intended to mean a functional linkage between two or more elements.

For example, an operable linkage between a promoter and a coding region of interest (e.g., region coding for an RGN, crRNA, tracrRNAs, and/or sgRNAs) is a functional link that allows for expression of the coding region of interest. Operably linked elements may be contiguous or non-contiguous. When used to refer to the joining of two protein coding regions, by operably linked is intended that the coding regions are in the same reading frame. Alternatively, the additional gene(s) or element(s) can be provided on multiple expression cassettes. For example, the nucleotide sequence encoding a presently disclosed RGN can be present on one expression cassette, whereas the nucleotide sequence encoding a crRNA, tracrRNA, or complete guide RNA can be on a separate expression cassette. Such an expression cassette is provided with a plurality of restriction sites and/or recombination sites for insertion of the polynucleotides to be under the transcriptional regulation of the regulatory regions. The expression cassette may additionally contain a selectable marker gene.

The expression cassette will include in the 5'-3' direction of transcription, a transcriptional (and, in some embodiments, translational) initiation region (i.e., a promoter), an RGN-, crRNA-, tracrRNA- and/or sgRNA-encoding polynucleotide of the invention, and a transcriptional (and in some embodiments, translational) termination region (i.e., termination region) functional in the organism of interest. The promoters of the invention are capable of directing or driving expression of a coding sequence in a host cell. The regulatory regions (e.g., promoters, transcriptional regulatory regions, and translational termination regions) may be endogenous or heterologous to the host cell or to each other. As used herein, "heterologous" in reference to a sequence is a sequence that originates from a foreign species, or, if from the same species, is substantially modified from its native form in composition and/or genomic locus by deliberate human intervention. As used herein, a chimeric gene comprises a coding sequence operably linked to a transcription initiation region that is heterologous to the coding sequence.

Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Additional regulatory signals include, but are not limited to, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EPO 0480762A2; Sambrook et al. (1992) Molecular Cloning: A Laboratory Manual, ed. Maniatis et al. (Cold Spring Harbor Laboratory Press, Cold Spring Harbor, N.Y.), hereinafter "Sambrook 11"; Davis et al., eds. (1980) Advanced Bacterial Genetics (Cold Spring Harbor Laboratory Press), Cold Spring Harbor, N.Y., and the references cited therein.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, inducible, growth stage-specific, cell type-specific, tissue-preferred, tissue-specific, or other promoters for expression in the organism of interest. See, for example, promoters set forth in WO 99/43838 and in U.S. Pat. Nos. 8,575,425; 7,790,846; 8,147,856; 8,586832; 7,772,369; 7,534,939; 6,072,050; 5,659,026; 5,608,149; 5,608,144; 5,604,121; 5,569,597; 5,466,785; 5,399,680; 5,268,463; 5,608,142; and 6,177,611; herein incorporated by reference.

For expression in plants, constitutive promoters also include CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); and MAS (Velten et al. (1984) *EMBO J.* 3:2723-2730).

Examples of inducible promoters are the Adh1 promoter which is inducible by hypoxia or cold stress, the Hsp70 promoter which is inducible by heat stress, the PPDK promoter and the pepcarboxylase promoter which are both inducible by light. Also useful are promoters which are chemically inducible, such as the In2-2 promoter which is safener induced (U.S. Pat. No. 5,364,780), the Axig 1 promoter which is auxin induced and tapetum specific but also active in callus (PCT US01/22169), the steroid-responsive promoters (see, for example, the ERE promoter which is estrogen induced, and the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-specific or tissue-preferred promoters can be utilized to target expression of an expression construct within a particular tissue. In certain embodiments, the tissue-specific or tissue-preferred promoters are active in plant tissue. Examples of promoters under developmental control in plants include promoters that initiate transcription preferentially in certain tissues, such as leaves, roots, fruit, seeds, or flowers. A "tissue specific" promoter is a promoter that initiates transcription only in certain tissues. Unlike constitutive expression of genes, tissue-specific expression is the result of several interacting levels of gene regulation. As such, promoters from homologous or closely related plant species can be preferable to use to achieve efficient and reliable expression of transgenes in particular tissues. In some embodiments, the expression comprises a tissue-preferred promoter. A "tissue preferred" promoter is a promoter that initiates transcription preferentially, but not necessarily entirely or solely in certain tissues.

In some embodiments, the nucleic acid molecules encoding an RGN, crRNA, and/or tracrRNA comprise a cell type-specific promoter. A "cell type specific" promoter is a promoter that primarily drives expression in certain cell types in one or more organs. Some examples of plant cells in which cell type specific promoters functional in plants may be primarily active include, for example, BETL cells, vascular cells in roots, leaves, stalk cells, and stem cells. The nucleic acid molecules can also include cell type preferred promoters. A "cell type preferred" promoter is a promoter that primarily drives expression mostly, but not necessarily entirely or solely in certain cell types in one or more organs. Some examples of plant cells in which cell type preferred promoters functional in plants may be preferentially active include, for example, BETL cells, vascular cells in roots, leaves, stalk cells, and stem cells.

The nucleic acid sequences encoding the RGNs, crRNAs, tracrRNAs, and/or sgRNAs can be operably linked to a promoter sequence that is recognized by a phage RNA polymerase for example, for in vitro mRNA synthesis. In such embodiments, the in vitro-transcribed RNA can be purified for use in the methods described herein. For example, the promoter sequence can be a T7, T3, or SP6 promoter sequence or a variation of a T7, T3, or SP6 promoter sequence. In such embodiments, the expressed protein and/or RNAs can be purified for use in the methods of genome modification described herein.

In certain embodiments, the polynucleotide encoding the RGN, crRNA, tracrRNA, and/or sgRNA also can be linked to a polyadenylation signal (e.g., SV40 polyA signal and other signals functional in plants) and/or at least one transcriptional termination sequence. Additionally, the sequence encoding the RGN also can be linked to sequence(s) encoding at least one nuclear localization signal, at least one cell-penetrating domain, and/or at least one signal peptide capable of trafficking proteins to particular subcellular locations, as described elsewhere herein.

The polynucleotide encoding the RGN, crRNA, tracrRNA, and/or sgRNA can be present in a vector or multiple vectors. A "vector" refers to a polynucleotide composition for transferring, delivering, or introducing a nucleic acid into a host cell. Suitable vectors include plasmid vectors, phagemids, cosmids, artificial/mini-chromosomes, transposons, and viral vectors (e.g., lentiviral vectors, adeno-associated viral vectors, baculoviral vector). The vector can comprise additional expression control sequences (e.g., enhancer sequences, Kozak sequences, polyadenylation sequences, transcriptional termination sequences), selectable marker sequences (e.g., antibiotic resistance genes), origins of replication, and the like. Additional information can be found in "Current Protocols in Molecular Biology" Ausubel et al., John Wiley & Sons, New York, 2003 or "Molecular Cloning: A Laboratory Manual" Sambrook & Russell, Cold Spring Harbor Press, Cold Spring Harbor, N.Y., 3rd edition, 2001.

The vector can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D).

In some embodiments, the expression cassette or vector comprising the sequence encoding the RGN polypeptide can further comprise a sequence encoding a crRNA and/or a tracrRNA, or the crRNA and tracrRNA combined to create a guide RNA. The sequence(s) encoding the crRNA and/or tracrRNA can be operably linked to at least one transcriptional control sequence for expression of the crRNA and/or tracrRNA in the organism or host cell of interest. For example, the polynucleotide encoding the crRNA and/or tracrRNA can be operably linked to a promoter sequence that is recognized by RNA polymerase III (Pol III). Examples of suitable Pol III promoters include, but are not limited to, mammalian U6, U3, H1, and 7SL RNA promoters and rice U6 and U3 promoters.

As indicated, expression constructs comprising nucleotide sequences encoding the RGNs, crRNA, tracrRNA, and/or sgRNA can be used to transform organisms of interest. Methods for transformation involve introducing a nucleotide construct into an organism of interest. By "introducing" is intended to introduce the nucleotide construct to the host cell in such a manner that the construct gains access to the interior of the host cell. The methods of the invention do not require a particular method for introducing a nucleotide construct to a host organism, only that the nucleotide construct gains access to the interior of at least one cell of the host organism. The host cell can be a eukaryotic or prokaryotic cell. In particular embodiments, the eukaryotic host cell is a plant cell, a mammalian cell, an avian cell, or an insect cell. In some embodiments, the eukaryotic cell that comprises or expresses a presently disclosed RGN or that has been modified by a presently disclosed RGN is a human cell. In some embodiments, the eukaryotic cell that comprises or expresses a presently disclosed RGN or that has been modified by a presently disclosed RGN is a cell of hematopoietic origin, such as an immune cell (i.e., a cell of the innate or adaptive immune system) including but not limited to a B cell, a T cell, a natural killer (NK) cell, a pluripotent stem cell, an induced pluripotent stem cell, a chimeric antigen receptor T (CAR-T) cell, a monocyte, a macrophage, and a dendritic cell.

Methods for introducing nucleotide constructs into plants and other host cells are known in the art including, but not limited to, stable transformation methods, transient transformation methods, and virus-mediated methods.

The methods result in a transformed organism, such as a plant, including whole plants, as well as plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic organisms" or "transformed organisms" or "stably transformed" organisms or cells or tissues refers to organisms that have incorporated or integrated a polynucleotide encoding an RGN, crRNA, and/or tracrRNA of the invention. It is recognized that other exogenous or endogenous nucleic acid sequences or DNA fragments may also be incorporated into the host cell. *Agrobacterium*- and biolistic-mediated transformation remain the two predominantly employed approaches for transformation of plant cells. However, transformation of a host cell may be performed by infection, transfection, microinjection, electroporation, microprojection, biolistics or particle bombardment, electroporation, silica/carbon fibers, ultrasound mediated, PEG mediated, calcium phosphate co-precipitation, polycation DMSO technique, DEAE dextran procedure, and viral mediated, liposome mediated and the like. Viral-mediated introduction of a polynucleotide encoding an RGN, crRNA, and/or tracrRNA includes retroviral, lentiviral, adenoviral, and adeno-associated viral mediated introduction and expression, as well as the use of Cauliomoviruses, Geminiviruses, and RNA plant viruses.

Transformation protocols as well as protocols for introducing polypeptides or polynucleotide sequences into plants may vary depending on the type of host cell (e.g., monocot or dicot plant cell) targeted for transformation. Methods for transformation are known in the art and include those set forth in U.S. Pat. Nos. 8,575,425; 7,692,068; 8,802,934; 7,541,517; each of which is herein incorporated by reference. See, also, Rakoczy-Trojanowska, M. (2002) *Cell Mol Biol Lett.* 7:849-858; Jones et al. (2005) *Plant Methods* 1:5; Rivera et al. (2012) *Physics of Life Reviews* 9:308-345; Bartlett et al. (2008) *Plant Methods* 4:1-12; Bates, G. W. (1999) *Methods in Molecular Biology* 111:359-366; Binns and Thomashow (1988) *Annual Reviews in Microbiology* 42:575-606; Christou, P. (1992) *The Plant Journal* 2:275-281; Christou, P. (1995) *Euphytica* 85:13-27; Tzfira et al. (2004) *TRENDS in Genetics* 20:375-383; Yao et al. (2006) *Journal of Experimental Botany* 57:3737-3746; Zupan and Zambryski (1995) *Plant Physiology* 107:1041-1047; Jones et al. (2005) *Plant Methods* 1:5;

Transformation may result in stable or transient incorporation of the nucleic acid into the cell. "Stable transformation" is intended to mean that the nucleotide construct introduced into a host cell integrates into the genome of the host cell and is capable of being inherited by the progeny thereof. "Transient transformation" is intended to mean that a polynucleotide is introduced into the host cell and does not integrate into the genome of the host cell.

Methods for transformation of chloroplasts are known in the art. See, for example, Svab et al. (1990) *Proc. Natl. Acad. Sci. USA* 87:8526-8530; Svab and Maliga (1993) *Proc. Natl. Acad. Sci. USA* 90:913-917; Svab and Maliga (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) *Proc. Natl. Acad. Sci. USA* 91:7301-7305.

The cells that have been transformed may be grown into a transgenic organism, such as a plant, in accordance with conventional ways. See, for example, McCormick et al. (1986) *Plant Cell Reports* 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

Alternatively, cells that have been transformed may be introduced into an organism. These cells could have originated from the organism, wherein the cells are transformed in an ex vivo approach.

The sequences provided herein may be used for transformation of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, *papaya*, cashew, macadamia, almond, oats, vegetables, ornamentals, and conifers.

Vegetables include, but are not limited to, tomatoes, lettuce, green beans, lima beans, peas, and members of the genus *Curcumis* such as cucumber, cantaloupe, and musk melon. Ornamentals include, but are not limited to, azalea, *hydrangea*, hibiscus, roses, tulips, daffodils, petunias, carnation, poinsettia, and *chrysanthemum*. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape, etc.).

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides. Further provided is a processed plant product or byproduct that retains the sequences disclosed herein, including for example, soymeal.

The polynucleotides encoding the RGNs, crRNAs, and/or tracrRNAs can also be used to transform any prokaryotic species, including but not limited to, archaea and bacteria (e.g., *Bacillus* sp., *Klebsiella* sp. *Streptomyces* sp., *Rhizobium* sp., *Escherichia* sp., *Pseudomonas* sp., *Salmonella* sp., *Shigella* sp., *Vibrio* sp., *Yersinia* sp., *Mycoplasma* sp., *Agrobacterium*, *Lactobacillus* sp.).

The polynucleotides encoding the RGNs, crRNAs, and/or tracrRNAs can be used to transform any eukaryotic species, including but not limited to animals (e.g., mammals, insects, fish, birds, and reptiles), fungi, amoeba, algae, and yeast.

Conventional viral and non-viral based gene transfer methods can be used to introduce nucleic acids in mammalian, insect, or avian cells or target tissues. Such methods can be used to administer nucleic acids encoding components of an RGN system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256: 808-813 (1992); Nabel & Feigner, TIBTECH 11:211-217 (1993); Mitani & Caskey, TIBTECH 11:162-166 (1993); Dillon, TIBTECH 11:167-175 (1993); Miller, Nature 357: 455-460 (1992); Van Brunt, Biotechnology 6(10): 1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration). The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Viral. 66:2731-2739 (1992); Johann et al., J. Viral. 66:1635-1640 (1992); Sommnerfelt et al., Viral. 176:58-59 (1990); Wilson et al., J. Viral. 63:2374-2378 (1989); Miller et al., I. Viral. 65:2220-2224 (1991); PCT/US94/05700).

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Katin, Human Gene Therapy 5:793-801 (1994); Muzyczka, I. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., I. Viral. 63:03822-3828 (1989). Packaging cells are typically used to form virus particles that are capable of infecting a host cell. Such cells include 293 cells, which package adenovirus, and ψJ2 cells or PA317 cells, which package retrovirus.

Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences.

The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. In some embodiments, the cell line may be mammalian, insect, or avian cells. A wide variety of cell lines for tissue culture are known in the art. Examples of cell lines include, but are not limited to, C8161, CCRF-CEM, MOLT, mIMCD-3, NHDF, HeLaS3, Huh1, Huh4, Huh7, HUVEC, HASMC, HEKn, HEKa, MiaPaCell, Panel, PC-3, TF1, CTLL-2, CIR, Rat6, CVI, RPTE, AlO, T24, 182, A375, ARH-77, Calu1, SW480, SW620, SKOV3, SK-UT, CaCo2, P388D1, SEM-K2, WEHI-231, HB56, TIB55, Jurkat, 145.01, LRMB, Bcl-1, BC-3, IC21, DLD2, Raw264.7, NRK, NRK-52E, MRC5, MEF, Hep G2, HeLa B, HeLa T4. COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-I cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr−/−, COR-L23, COR-L23/CPR, COR-L235010, CORL23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalclc7, HL-60, HMEC, HT-29, Jurkat, IY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCKII, MDCKII, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)).

In some embodiments, a cell transfected with one or more vectors described herein is used to establish a new cell line comprising one or more vector-derived sequences. In some embodiments, a cell transiently transfected with the components of an RGN system as described herein (such as by transient transfection of one or more vectors, or transfection with RNA), and modified through the activity of an RGN system, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is a mammal, such as a mouse, rat, hamster, rabbit, cow, or pig. In some embodiments, the transgenic animal is a bird, such as a chicken or a duck. In some embodiments, the transgenic animal is an insect, such as a mosquito or a tick.

IV. Variants and Fragments of Polypeptides and Polynucleotides

The present disclosure provides active variants and fragments of a naturally-occurring (i.e., wild-type) RNA-guided nuclease, the amino acid sequence of which is set forth as SEQ ID NOs: 1, 8, 15, 22, 29, 36, 43, 50, 56, 63, 70, 76, 83, 89, 96, 103, 110, 117, 123, or 570-579, as well as active variants and fragments of naturally-occurring CRISPR repeats, such as the sequence set forth as SEQ ID NOs: 2, 9, 16, 23, 30, 37, 44, 51, 57, 64, 71, 77, 84, 90, 97, 104, 111, 118, or 124, and active variant and fragments of naturally-occurring tracrRNAs, such as the sequence set forth as SEQ ID NOs: 3, 10, 17, 24, 31, 38, 45, 52, 58, 65, 72, 78, 85, 91, 98, 105, 112, 119, or 125, and polynucleotides encoding the same.

While the activity of a variant or fragment may be altered compared to the polynucleotide or polypeptide of interest, the variant and fragment should retain the functionality of the polynucleotide or polypeptide of interest. For example, a variant or fragment may have increased activity, decreased activity, different spectrum of activity or any other alteration in activity when compared to the polynucleotide or polypeptide of interest.

Fragments and variants of naturally-occurring RGN polypeptides, such as those disclosed herein, will retain sequence-specific, RNA-guided DNA-binding activity. In particular embodiments, fragments and variants of naturally-occurring RGN polypeptides, such as those disclosed herein, will retain nuclease activity (single-stranded or double-stranded).

Fragments and variants of naturally-occurring CRISPR repeats, such as those disclosed herein, will retain the ability, when part of a guide RNA (comprising a tracrRNA), to bind to and guide an RNA-guided nuclease (complexed with the guide RNA) to a target nucleotide sequence in a sequence-specific manner.

Fragments and variants of naturally-occurring tracrRNAs, such as those disclosed herein, will retain the ability, when part of a guide RNA (comprising a CRISPR RNA), to guide an RNA-guided nuclease (complexed with the guide RNA) to a target nucleotide sequence in a sequence-specific manner.

The term "fragment" refers to a portion of a polynucleotide or polypeptide sequence of the invention. "Fragments" or "biologically active portions" include polynucleotides comprising a sufficient number of contiguous nucleotides to retain the biological activity (i.e., binding to and directing an RGN in a sequence-specific manner to a target nucleotide sequence when comprised within a guideRNA). "Fragments" or "biologically active portions" include polypeptides comprising a sufficient number of contiguous amino acid residues to retain the biological activity (i.e., binding to a target nucleotide sequence in a sequence-specific manner when complexed with a guide RNA). Fragments of the RGN proteins include those that are shorter than the full-length sequences due to the use of an alternate downstream start site. A biologically active portion of an RGN protein can be a polypeptide that comprises, for example, 10, 25, 50, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700 or more contiguous amino acid residues of SEQ ID NOs: 1, 8, 15, 22, 29, 36, 43, 50, 56, 63, 70, 76, 83, 89, 96, 103, 110, 117, 123, or 570-579. Such biologically active portions can be prepared by recombinant techniques and evaluated for sequence-specific, RNA-guided DNA-binding activity. A biologically active fragment of a CRISPR repeat sequence can comprise at least 8 contiguous amino acids of SEQ ID NOs: 2, 9, 16, 23, 30, 37, 44, 51, 57, 64, 71, 77, 84, 90, 97, 104, 111, 118, or 124. A biologically active portion of a CRISPR repeat sequence can be a polynucleotide that comprises, for example, 8, 9, 10, 11, 12, 13, 14, 15, 16, 17, 18, 19, 20, 21, or 22 contiguous nucleotides of SEQ ID NOs: 2, 9, 16, 23, 30, 37, 44, 51, 57, 64, 71, 77, 84, 90, 97, 104, 111, 118, or 124. A biologically active portion of a tracrRNA can be a polynucleotide that comprises, for example, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 105, 110 or more contiguous nucleotides of SEQ ID NOs: 3, 10, 17, 24, 31, 38, 45, 52, 58, 65, 72, 78, 85, 91, 98, 105, 112, 119, or 125.

In general, "variants" is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. As used herein, a "native" or "wild type" polynucleotide or polypeptide comprises a naturally occurring nucleotide sequence or amino acid sequence, respectively. For polynucleotides, conservative variants include those sequences that, because of the degeneracy of the genetic code, encode the native amino acid sequence of the gene of interest. Naturally occurring allelic variants such as these can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis but which still encode the polypeptide or the polynucleotide of interest. Generally, variants of a particular polynucleotide disclosed herein will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

Variants of a particular polynucleotide disclosed herein (i.e., the reference polynucleotide) can also be evaluated by comparison of the percent sequence identity between the polypeptide encoded by a variant polynucleotide and the polypeptide encoded by the reference polynucleotide. Percent sequence identity between any two polypeptides can be calculated using sequence alignment programs and parameters described elsewhere herein. Where any given pair of polynucleotides disclosed herein is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

In particular embodiments, the presently disclosed polynucleotides encode an RNA-guided nuclease polypeptide comprising an amino acid sequence having at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or greater identity to an amino acid sequence of SEQ ID NOs: 1, 8, 15, 22, 29, 36, 43, 50, 56, 63, 70, 76, 83, 89, 96, 103, 110, 117, 123, or 570-579. In some embodiments, variants of SEQ ID NO: 63 maintain the isoleucine at an amino acid position corresponding to 305, the valine at an amino acid position corresponding to 328, the leucine at an amino acid position corresponding to 366, the threonine at an amino acid position corresponding to 368, and the valine at an amino acid position corresponding to 405 of SEQ ID NO: 63. An amino acid position of a first amino acid sequence "corresponding to" a particular position of a second amino acid sequence refers to the position in the first amino acid sequence when the first and second amino acid sequences are optimally aligned that lines up with the specified amino acid residue position in the second sequence. In particular embodiments, variants of SEQ ID NO: 63 have at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or greater identity to SEQ ID NO: 63 outside of these amino acid residues that are maintained from SEQ ID NO: 63 (i.e., I305, V328, L366, T368, and V405).

A biologically active variant of an RGN polypeptide of the invention may differ by as few as about 1-15 amino acid residues, as few as about 1-10, such as about 6-10, as few as 5, as few as 4, as few as 3, as few as 2, or as few as 1 amino acid residue. In specific embodiments, the polypeptides can comprise an N-terminal or a C-terminal truncation, which can comprise at least a deletion of 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700 amino acids or more from either the N or C terminus of the polypeptide.

In certain embodiments, the presently disclosed polynucleotides comprise or encode a CRISPR repeat comprising a nucleotide sequence having at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or greater identity to the nucleotide sequence set forth as SEQ ID NOs: 2, 9, 16, 23, 30, 37, 44, 51, 57, 64, 71, 77, 84, 90, 97, 104, 111, 118, or 124.

The presently disclosed polynucleotides can comprise or encode a tracrRNA comprising a nucleotide sequence having at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or greater identity to the nucleotide sequence set forth as SEQ ID NOs: 3, 10, 17, 24, 31, 38, 45, 52, 58, 65, 72, 78, 85, 91, 98, 105, 112, 119, or 125.

Biologically active variants of a CRISPR repeat or tracrRNA of the invention may differ by as few as about 1-15 nucleotides, as few as about 1-10, such as about 6-10, as few as 5, as few as 4, as few as 3, as few as 2, or as few as 1 nucleotide. In specific embodiments, the polynucleotides can comprise a 5' or 3' truncation, which can comprise at least a deletion of 10, 15, 20, 25, 30, 35, 40, 45, 50, 55, 60, 65, 70, 75, 80, 90, 95, 100, 105, 110 nucleotides or more from either the 5' or 3' end of the polynucleotide.

It is recognized that modifications may be made to the RGN polypeptides, CRISPR repeats, and tracrRNAs provided herein creating variant proteins and polynucleotides. Changes designed by man may be introduced through the application of site-directed mutagenesis techniques. Alternatively, native, as yet-unknown or as yet unidentified polynucleotides and/or polypeptides structurally and/or functionally-related to the sequences disclosed herein may also be identified that fall within the scope of the present invention. Conservative amino acid substitutions may be made in nonconserved regions that do not alter the function of the RGN proteins. Alternatively, modifications may be made that improve the activity of the RGN.

Variant polynucleotides and proteins also encompass sequences and proteins derived from a mutagenic and recombinogenic procedure such as DNA shuffling. With such a procedure, one or more different RGN proteins disclosed herein (e.g., SEQ ID NOs: 1, 8, 15, 22, 29, 36, 43, 50, 56, 63, 70, 76, 83, 89, 96, 103, 110, 117, 123, or 570-579) is manipulated to create a new RGN protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the RGN sequences provided herein and other known RGN genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458. A "shuffled" nucleic acid is a nucleic acid produced by a shuffling procedure such as any shuffling procedure set forth herein. Shuffled nucleic acids are produced by recombining (physically or virtually) two or more nucleic acids (or character strings), for example in an artificial, and optionally recursive, fashion. Generally, one or more screening steps are used in shuffling processes to identify nucleic acids of interest; this screening step can be performed before or after any recombination step. In some (but not all) shuffling embodiments, it is desirable to perform multiple rounds of recombination prior to selection to increase the diversity of the pool to be screened. The overall process of recombination and selection are optionally repeated recursively. Depending on context, shuffling can refer to an overall process of recombination and selection, or, alternately, can simply refer to the recombinational portions of the overall process.

As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically, this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, California).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10.

Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art and described, e.g., in Dayhoff et al. (1978) "A model of evolutionary change in proteins." In "Atlas of Protein Sequence and Structure," Vol. 5, Suppl. 3 (ed. M. O. Dayhoff), pp. 345-352. Natl. Biomed. Res. Found., Washington, D.C. and Henikoff et al. (1992) Proc. Natl. Acad. Sci. USA 89:10915-10919. The BLOSUM62 matrix is often used as a default scoring substitution matrix in sequence alignment protocols. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. While optimal alignment and scoring can be accomplished manually, the process is facilitated by the use of a computer-implemented alignment algorithm, e.g., gapped BLAST 2.0, described in Altschul et al. (1997) *Nucleic Acids Res.* 25:3389-3402, and made available to the public at the National Center for Biotechnology Information Website (www.ncbi.nlm.nih.gov). Optimal alignments, including multiple alignments, can be prepared using, e.g., PSI-BLAST, available through www.ncbi.nlm.nih.gov and described by Altschul et al. (1997) *Nucleic Acids Res.* 25:3389-3402.

With respect to an amino acid sequence that is optimally aligned with a reference sequence, an amino acid residue "corresponds to" the position in the reference sequence with which the residue is paired in the alignment. The "position" is denoted by a number that sequentially identifies each amino acid in the reference sequence based on its position relative to the N-terminus. Owing to deletions, insertion, truncations, fusions, etc., that must be taken into account when determining an optimal alignment, in general the amino acid residue number in a test sequence as determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

V. Antibodies

Antibodies to the RGN polypeptides or ribonucleoproteins comprising the RGN polypeptides of the present invention, including those having the amino acid sequence set forth as SEQ ID NOs: 1, 8, 15, 22, 29, 36, 43, 50, 56, 63, 70, 76, 83, 89, 96, 103, 110, 117, 123, or 570-579 or active variants or fragments thereof, are also encompassed. Methods for producing antibodies are well known in the art (see, for example, Harlow and Lane (1988) Antibodies: A Laboratory Manual, Cold Spring Harbor Laboratory, Cold Spring Harbor, N.Y.; and U.S. Pat. No. 4,196,265). These antibodies can be used in kits for the detection and isolation of RGN polypeptides or ribonucleoproteins. Thus, this disclosure provides kits comprising antibodies that specifically bind to the polypeptides or ribonucleoproteins described herein, including, for example, polypeptides having the sequence of SEQ ID NOs: 1, 8, 15, 22, 29, 36, 43, 50, 56, 63, 70, 76, 83, 89, 96, 103, 110, 117, 123, or 570-579.

VI. Systems and Ribonucleoprotein Complexes for Binding a Target Sequence of Interest and Methods of Making the Same The present disclosure provides a system for binding a target sequence of interest, wherein the system comprises at least one guide RNA or a nucleotide sequence encoding the same, and at least one RNA-guided nuclease or a nucleotide sequence encoding the same. The guide RNA hybridizes to the target sequence of interest and also forms a complex with the RGN polypeptide, thereby directing the RGN polypeptide to bind to the target sequence. In some of these embodiments, the RGN comprises an amino acid sequence of SEQ ID NOs: 1, 8, 15, 22, 29, 36, 43, 50, 56, 63, 70, 76, 83, 89, 96, 103, 110, 117, 123, or 570-579, or an active variant or fragment thereof. In various embodiments, the guide RNA comprises a CRISPR repeat sequence comprising the nucleotide sequence of SEQ ID NOs: 2, 9, 16, 23, 30, 37, 44, 51, 57, 64, 71, 77, 84, 90, 97, 104, 111, 118, or 124, or an active variant or fragment thereof. In particular embodiments, the guide RNA comprises a tracrRNA comprising a nucleotide sequence of SEQ ID NOs: 3, 10, 17, 24, 31, 38, 45, 52, 58, 65, 72, 78, 85, 91, 98, 105, 112, 119, or 125, or an active variant or fragment thereof. The guide RNA of the system can be a single guide RNA or a dual-guide RNA. In particular embodiments, the system comprises an RNA-guided nuclease that is heterologous to the guideRNA, wherein the RGN and guideRNA are not found complexed to one another (i.e., bound to one another) in nature.

The system for binding a target sequence of interest provided herein can be a ribonucleoprotein complex, which is at least one molecule of an RNA bound to at least one protein. The ribonucleoprotein complexes provided herein comprise at least one guide RNA as the RNA component and an RNA-guided nuclease as the protein component. Such ribonucleoprotein complexes can be purified from a cell or organism that naturally expresses an RGN polypeptide and has been engineered to express a particular guide RNA that is specific for a target sequence of interest. Alternatively, the ribonucleoprotein complex can be purified from a cell or organism that has been transformed with polynucleotides that encode an RGN polypeptide and a guide RNA and cultured under conditions to allow for the expression of the RGN polypeptide and guide RNA. Thus, methods are provided for making an RGN polypeptide or an RGN ribonucleoprotein complex. Such methods comprise culturing a cell comprising a nucleotide sequence encoding an RGN polypeptide, and in some embodiments a nucleotide sequence encoding a guide RNA, under conditions in which the RGN polypeptide (and in some embodiments, the guide RNA) is expressed. The RGN polypeptide or RGN ribonucleoprotein can then be purified from a lysate of the cultured cells.

Methods for purifying an RGN polypeptide or RGN ribonucleoprotein complex from a lysate of a biological sample are known in the art (e.g., size exclusion and/or affinity chromatography, 2D-PAGE, HPLC, reversed-phase chromatography, immunoprecipitation). In particular methods, the RGN polypeptide is recombinantly produced and comprises a purification tag to aid in its purification, including but not limited to, glutathione-S-transferase (GST), chitin binding protein (CBP), maltose binding protein, thioredoxin (TRX), poly(NANP), tandem affinity purification (TAP) tag, myc, AcV5, AU1, AU5, E, ECS, E2, FLAG, HA, nus, Softag 1, Softag 3, Strep, SBP, Glu-Glu, HSV, KT3, S, S1, T7, V5, VSV-G, 6×His, 10×His, biotin carboxyl carrier protein (BCCP), and calmodulin. Generally, the tagged RGN polypeptide or RGN ribonucleoprotein complex is purified using immobilized metal affinity chromatography. It will be appreciated that other similar methods known in the art may be used, including other forms of chromatography or for example immunoprecipitation, either alone or in combination.

An "isolated" or "purified" polypeptide, or biologically active portion thereof, is substantially or essentially free from components that normally accompany or interact with the polypeptide as found in its naturally occurring environment. Thus, an isolated or purified polypeptide is substantially free of other cellular material, or culture medium when produced by recombinant techniques, or substantially free of chemical precursors or other chemicals when chemically synthesized. A protein that is substantially free of cellular material includes preparations of protein having less than about 30%, 20%, 10%, 5%, or 1% (by dry weight) of contaminating protein. When the protein of the invention or biologically active portion thereof is recombinantly produced, optimally culture medium represents less than about 30%, 20%, 10%, 5%, or 1% (by dry weight) of chemical precursors or non-protein-of-interest chemicals.

Particular methods provided herein for binding and/or cleaving a target sequence of interest involve the use of an in vitro assembled RGN ribonucleoprotein complex. In vitro assembly of an RGN ribonucleoprotein complex can be performed using any method known in the art in which an RGN polypeptide is contacted with a guide RNA under conditions to allow for binding of the RGN polypeptide to the guide RNA. As used herein, "contact", contacting", "contacted," refer to placing the components of a desired reaction together under conditions suitable for carrying out the desired reaction. The RGN polypeptide can be purified from a biological sample, cell lysate, or culture medium, produced via in vitro translation, or chemically synthesized. The guide RNA can be purified from a biological sample, cell lysate, or culture medium, transcribed in vitro, or chemically synthesized. The RGN polypeptide and guide RNA can be brought into contact in solution (e.g., buffered saline solution) to allow for in vitro assembly of the RGN ribonucleoprotein complex.

VII. Methods of Binding, Cleaving, or Modifying a Target Sequence

The present disclosure provides methods for binding, cleaving, and/or modifying a target nucleotide sequence of interest. The methods include delivering a system comprising at least one guide RNA or a polynucleotide encoding the same, and at least one RGN polypeptide or a polynucleotide encoding the same to the target sequence or a cell, organelle, or embryo comprising the target sequence. In some of these embodiments, the RGN comprises the amino acid sequence of SEQ ID NOs: 1, 8, 15, 22, 29, 36, 43, 50, 56, 63, 70, 76, 83, 89, 96, 103, 110, 117, 123, or 570-579, or an active variant or fragment thereof. In various embodiments, the guide RNA comprises a CRISPR repeat sequence comprising the nucleotide sequence of SEQ ID NOs: 2, 9, 16, 23, 30, 37, 44, 51, 57, 64, 71, 77, 84, 90, 97, 104, 111, 118, or 124, or an active variant or fragment thereof. In particular embodiments, the guide RNA comprises a tracrRNA comprising the nucleotide sequence of SEQ ID NOs: 3, 10, 17, 24, 31, 38, 45, 52, 58, 65, 72, 78, 85, 91, 98, 105, 112, 119, or 125, or an active variant or fragment thereof. The guide RNA of the system can be a single guide RNA or a dual-guide RNA. The RGN of the system may be nuclease dead RGN, have nickase activity, or may be a fusion polypeptide. In some embodiments, the fusion polypeptide comprises a base-editing polypeptide, for example a cytidine deaminase or an adenosine deaminase. In other embodiments, the RGN fusion protein comprises a reverse transcriptase. In other embodiments, the RGN fusion protein comprises a polypeptide that recruits members of a functional nucleic acid repair complex, such as a member of the nucleotide excision repair (NER) or transcription coupled-nucleotide excision repair (TC-NER) pathway (Wei et al., 2015, *PNAS USA* 112(27):E3495-504; Troelstra et al., 1992, *Cell* 71:939-953; Marnef et al., 2017, *J Mol Biol* 429(9): 1277-1288), as described in U.S. Provisional Application No. 62/966,203, which was filed on Jan. 27, 2020, and is incorporated by reference in its entirety. In some embodiments, the RGN fusion protein comprises CSB (van den Boom et al., 2004, *J Cell Biol* 166(1):27-36; van Gool et al., 1997, *EMBO J* 16(19):5955-65; an example of which is set forth as SEQ ID NO: 608), which is a member of the TC-NER (nucleotide excision repair) pathway and functions in the recruitment of other members. In further embodiments, the RGN fusion protein comprises an active domain of CSB, such as the acidic domain of CSB which comprises amino acid residues 356-394 of SEQ ID NO: 608 (Teng et al., 2018, *Nat Commun* 9(1):4115).

In particular embodiments, the RGN and/or guide RNA is heterologous to the cell, organelle, or embryo to which the RGN and/or guide RNA (or polynucleotide(s) encoding at least one of the RGN and guide RNA) are introduced.

In those embodiments wherein the method comprises delivering a polynucleotide encoding a guide RNA and/or an RGN polypeptide, the cell or embryo can then be cultured under conditions in which the guide RNA and/or RGN polypeptide are expressed. In various embodiments, the method comprises contacting a target sequence with an RGN ribonucleoprotein complex. The RGN ribonucleoprotein complex may comprise an RGN that is nuclease dead or has nickase activity. In some embodiments, the RGN of the ribonucleoprotein complex is a fusion polypeptide comprising a base-editing polypeptide. In certain embodiments, the method comprises introducing into a cell, organelle, or embryo comprising a target sequence an RGN ribonucleoprotein complex. The RGN ribonucleoprotein complex can be one that has been purified from a biological sample, recombinantly produced and subsequently purified, or in vitro-assembled as described herein. In those embodiments wherein the RGN ribonucleoprotein complex that is contacted with the target sequence or a cell organelle, or embryo has been assembled in vitro, the method can further comprise the in vitro assembly of the complex prior to contact with the target sequence, cell, organelle, or embryo.

A purified or in vitro assembled RGN ribonucleoprotein complex can be introduced into a cell, organelle, or embryo using any method known in the art, including, but not limited to electroporation. Alternatively, an RGN polypeptide and/or polynucleotide encoding or comprising the guide RNA can be introduced into a cell, organelle, or embryo using any method known in the art (e.g., electroporation).

Upon delivery to or contact with the target sequence or cell, organelle, or embryo comprising the target sequence, the guide RNA directs the RGN to bind to the target sequence in a sequence-specific manner. In those embodiments wherein the RGN has nuclease activity, the RGN polypeptide cleaves the target sequence of interest upon binding. The target sequence can subsequently be modified via endogenous repair mechanisms, such as non-homologous end joining, or homology-directed repair with a provided donor polynucleotide.

Methods to measure binding of an RGN polypeptide to a target sequence are known in the art and include chromatin immunoprecipitation assays, gel mobility shift assays, DNA pull-down assays, reporter assays, microplate capture and detection assays. Likewise, methods to measure cleavage or modification of a target sequence are known in the art and include in vitro or in vivo cleavage assays wherein cleavage is confirmed using PCR, sequencing, or gel electrophoresis, with or without the attachment of an appropriate label (e.g., radioisotope, fluorescent substance) to the target sequence to facilitate detection of degradation products. Alternatively, the nicking triggered exponential amplification reaction (NTEXPAR) assay can be used (see, e.g., Zhang et al. (2016) *Chem. Sci.* 7:4951-4957). In vivo cleavage can be evaluated using the Surveyor assay (Guschin et al. (2010) *Methods Mol Biol* 649:247-256).

In some embodiments, the methods involve the use of a single type of RGN complexed with more than one guide RNA. The more than one guide RNA can target different regions of a single gene or can target multiple genes.

In those embodiments wherein a donor polynucleotide is not provided, a double-stranded break introduced by an RGN polypeptide can be repaired by a non-homologous end-joining (NHEJ) repair process. Due to the error-prone nature of NHEJ, repair of the double-stranded break can result in a modification to the target sequence. As used herein, a "modification" in reference to a nucleic acid molecule refers to a change in the nucleotide sequence of the nucleic acid molecule, which can be a deletion, insertion, or substitution of one or more nucleotides, or a combination thereof. Modification of the target sequence can result in the expression of an altered protein product or inactivation of a coding sequence.

In those embodiments wherein a donor polynucleotide is present, the donor sequence in the donor polynucleotide can be integrated into or exchanged with the target nucleotide sequence during the course of repair of the introduced double-stranded break, resulting in the introduction of the exogenous donor sequence. A donor polynucleotide thus comprises a donor sequence that is desired to be introduced into a target sequence of interest. In some embodiments, the donor sequence alters the original target nucleotide sequence such that the newly integrated donor sequence will not be recognized and cleaved by the RGN. Integration of the donor sequence can be enhanced by the inclusion within the donor polynucleotide of flanking sequences, referred to herein as "homology arms" that have substantial sequence identity with the sequences flanking the target nucleotide sequence, allowing for a homology-directed repair process. In some embodiments, homology arms have a length of at least 50 base pairs, at least 100 base pairs, and up to 2000 base pairs or more, and have at least 90%, at least 95%, or more, sequence homology to their corresponding sequence within the target nucleotide sequence.

In those embodiments wherein the RGN polypeptide introduces double-stranded staggered breaks, the donor polynucleotide can comprise a donor sequence flanked by compatible overhangs, allowing for direct ligation of the donor sequence to the cleaved target nucleotide sequence comprising overhangs by a non-homologous repair process during repair of the double-stranded break.

In those embodiments wherein the method involves the use of an RGN that is a nickase (i.e., is only able to cleave a single strand of a double-stranded polynucleotide), the method can comprise introducing two RGN nickases that target identical or overlapping target sequences and cleave different strands of the polynucleotide. For example, an RGN nickase that only cleaves the positive (+) strand of a double-stranded polynucleotide can be introduced along with a second RGN nickase that only cleaves the negative (−) strand of a double-stranded polynucleotide.

In various embodiments, a method is provided for binding a target nucleotide sequence and detecting the target sequence, wherein the method comprises introducing into a cell, organelle, or embryo at least one guide RNA or a polynucleotide encoding the same, and at least one RGN polypeptide or a polynucleotide encoding the same, expressing the guide RNA and/or RGN polypeptide (if coding sequences are introduced), wherein the RGN polypeptide is a nuclease-dead RGN and further comprises a detectable label, and the method further comprises detecting the detectable label. The detectable label may be fused to the RGN as a fusion protein (e.g., fluorescent protein) or may be a small molecule conjugated to or incorporated within the RGN polypeptide that can be detected visually or by other means.

Also provided herein are methods for modulating the expression of a target sequence or a gene of interest under the regulation of a target sequence. The methods comprise introducing into a cell, organelle, or embryo at least one guide RNA or a polynucleotide encoding the same, and at least one RGN polypeptide or a polynucleotide encoding the same, expressing the guide RNA and/or RGN polypeptide (if coding sequences are introduced), wherein the RGN polypeptide is a nuclease-dead RGN. In some of these embodiments, the nuclease-dead RGN is a fusion protein comprising an expression modulator domain (i.e., epigenetic modification domain, transcriptional activation domain or a transcriptional repressor domain) as described herein.

The present disclosure also provides methods for binding and/or modifying a target nucleotide sequence of interest. The methods include delivering a system comprising at least one guide RNA or a polynucleotide encoding the same, and at least one fusion polypeptide comprises an RGN of the invention and a base-editing polypeptide, for example a cytidine deaminase or an adenosine deaminase, or a polynucleotide encoding the fusion polypeptide, to the target sequence or a cell, organelle, or embryo comprising the target sequence.

One of ordinary skill in the art will appreciate that any of the presently disclosed methods can be used to target a single target sequence or multiple target sequences. Thus, methods comprise the use of a single RGN polypeptide in combination with multiple, distinct guide RNAs, which can target multiple, distinct sequences within a single gene and/or multiple genes. Also encompassed herein are methods wherein multiple, distinct guide RNAs are introduced in combination with multiple, distinct RGN polypeptides. These guide RNAs and guide RNA/RGN polypeptide systems can target multiple, distinct sequences within a single gene and/or multiple genes.

In one aspect, the invention provides kits containing any one or more of the elements disclosed in the above methods and compositions. In some embodiments, the kit comprises a vector system and instructions for using the kit. In some embodiments, the vector system comprises (a) a first regulatory element operably linked to a DNA sequence encoding the crRNA sequence and one or more insertion sites for inserting a guide sequence upstream of the encoded crRNA sequence, wherein when expressed, the guide sequence directs sequence-specific binding of an RGN complex to a target sequence in a eukaryotic cell, wherein the RGN complex comprises an RGN enzyme complexed with the guide RNA polynucleotide; and/or (b) a second regulatory element operably linked to an enzyme coding sequence encoding said RGN enzyme comprising a nuclear localization sequence. Elements may be provided individually or in combinations, and may be provided in any suitable container, such as a vial, a bottle, or a tube.

In some embodiments, the kit includes instructions in one or more languages. In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10.

In some embodiments, the kit comprises one or more oligonucleotides corresponding to a guide sequence for insertion into a vector so as to operably link the guide sequence and a regulatory element. In some embodiments, the kit comprises a homologous recombination template polynucleotide. In one aspect, the invention provides methods for using one or more elements of an RGN system. The RGN system of the invention provides an effective means for modifying a target polynucleotide. The RGN system of the invention has a wide variety of utility including modifying (e.g., deleting, inserting, translocating, inactivating, activating, base editing) a target polynucleotide in a multiplicity of cell types. As such the RGN system of the invention has a broad spectrum of applications in, e.g., gene therapy, drug screening, disease diagnosis, and prognosis. An exemplary RGN system, or RGN complex, comprises an RGN enzyme complexed with a guide sequence hybridized to a target sequence within the target polynucleotide.

VIII. Target Polynucleotides

In one aspect, the invention provides for methods of modifying a target polynucleotide in a eukaryotic cell, which may be in vivo, ex vivo or in vitro. In some embodiments, the method comprises sampling a cell or population of cells from a human or non-human animal or plant (including microalgae) and modifying the cell or cells. Culturing may occur at any stage ex vivo. The cell or cells may even be re-introduced into the non-human animal or plant (including microalgae).

Using natural variability, plant breeders combine most useful genes for desirable qualities, such as yield, quality, uniformity, hardiness, and resistance against pests. These desirable qualities also include growth, day length preferences, temperature requirements, initiation date of floral or reproductive development, fatty acid content, insect resistance, disease resistance, nematode resistance, fungal resistance, herbicide resistance, tolerance to various environmental factors including drought, heat, wet, cold, wind, and adverse soil conditions including high salinity The sources of these useful genes include native or foreign varieties, heirloom varieties, wild plant relatives, and induced mutations, e.g., treating plant material with mutagenic agents. Using the present invention, plant breeders are provided with a new tool to induce mutations. Accordingly, one skilled in the art can analyze the genome for sources of useful genes, and in varieties having desired characteristics or traits employ the present invention to induce the rise of useful genes, with more precision than previous mutagenic agents and hence accelerate and improve plant breeding programs.

The target polynucleotide of an RGN system can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Without wishing to be bound by theory, the target sequence should be associated with a PAM (protospacer adjacent motif); that is, a short sequence recognized by the RGN system. The precise sequence and length requirements for the PAM differ depending on the RGN used, but PAMs are typically 2-5 base pair sequences adjacent the protospacer (that is, the target sequence).

The target polynucleotide of an RGN system may include a number of disease-associated genes and polynucleotides as well as signaling biochemical pathway-associated genes and polynucleotides. Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non-disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease (e.g., a causal mutation). The transcribed or translated products may be known or unknown, and further may be at a normal or abnormal level. In some embodiments, the disease may be an animal disease. In some embodiments, the disease may be an avian disease. In other embodiments, the disease may be a mammalian disease. In further embodiments, the disease may be a human disease. Examples of disease-associated genes and polynucleotides in humans are available from McKusick-Nathans Institute of Genetic Medicine, Johns Hopkins University (Baltimore, Md.) and National Center for Biotechnology Information, National Library of Medicine (Bethesda, Md.), available on the World Wide Web.

Although RGN systems are particularly useful for their relative ease in targeting to genomic sequences of interest, there still remains an issue of what the RGN can do to address a causal mutation. One approach is to produce a fusion protein between an RGN (preferably an inactive or nickase variant of the RGN) and a base-editing enzyme or the active domain of a base editing enzyme, such as a cytidine deaminase or an adenosine deaminase base editor (U.S. Pat. No. 9,840,699, herein incorporated by reference). In some embodiments, the methods comprise contacting a DNA molecule with (a) a fusion protein comprising an RGN of the invention and a base-editing polypeptide such as a deaminase; and (b) a gRNA targeting the fusion protein of (a) to a target nucleotide sequence of the DNA strand; wherein the DNA molecule is contacted with the fusion protein and the gRNA in an amount effective and under conditions suitable for the deamination of a nucleobase. In some embodiments, the target DNA sequence comprises a sequence associated with a disease or disorder, and wherein the deamination of the nucleobase results in a sequence that is not associated with a disease or disorder. In some embodiments, the target DNA sequence resides in an allele of a crop plant, wherein the particular allele of the trait of interest results in a plant of lesser agronomic value. The deamination of the nucleobase results in an allele that improves the trait and increases the agronomic value of the plant.

In some embodiments, the DNA sequence comprises a T→C or A→G point mutation associated with a disease or disorder, and wherein the deamination of the mutant C or G base results in a sequence that is not associated with a disease or disorder. In some embodiments, the deamination corrects a point mutation in the sequence associated with the disease or disorder.

In some embodiments, the sequence associated with the disease or disorder encodes a protein, and wherein the deamination introduces a stop codon into the sequence associated with the disease or disorder, resulting in a truncation of the encoded protein. In some embodiments, the contacting is performed in vivo in a subject susceptible to having, having, or diagnosed with the disease or disorder. In some embodiments, the disease or disorder is a disease associated with a point mutation, or a single-base mutation, in the genome. In some embodiments, the disease is a genetic disease, a cancer, a metabolic disease, or a lysosomal storage disease.

IX. Pharmaceutical Compositions and Methods of Treatment

Pharmaceutical compositions comprising the presently disclosed RGN polypeptides and active variants and fragments thereof, as well as polynucleotides encoding the same, the presently disclosed gRNAs or polynucleotides encoding the same, the presently disclosed systems, or cells comprising any of the RGN polypeptides or RGN-encoding polynucleotides, gRNA or gRNA-encoding polynucleotides, or the RGN systems, and a pharmaceutically acceptable carrier are provided.

A pharmaceutical composition is a composition that is employed to prevent, reduce in intensity, cure or otherwise treat a target condition or disease that comprises an active ingredient (i.e., RGN polypeptides, RGN-encoding polynucleotides, gRNA, gRNA-encoding polynucleotides, RGN systems, or cells comprising any one of these) and a pharmaceutically acceptable carrier.

As used herein, a "pharmaceutically acceptable carrier" refers to a material that does not cause significant irritation to an organism and does not abrogate the activity and properties of the active ingredient (i.e., RGN polypeptides, RGN-encoding polynucleotides, gRNA, gRNA-encoding polynucleotides, RGN systems, or cells comprising any one of these). Carriers must be of sufficiently high purity and of sufficiently low toxicity to render them suitable for administration to a subject being treated. The carrier can be inert, or it can possess pharmaceutical benefits. In some embodiments, a pharmaceutically acceptable carrier comprises one or more compatible solid or liquid filler, diluents or encapsulating substances which are suitable for administration to a human or other vertebrate animal. In some embodiments, the pharmaceutically acceptable carrier is not naturally-occurring. In some embodiments, the pharmaceutically acceptable carrier and the active ingredient are not found together in nature.

Pharmaceutical compositions used in the presently disclosed methods can be formulated with suitable carriers, excipients, and other agents that provide suitable transfer, delivery, tolerance, and the like. A multitude of appropriate formulations are known to those skilled in the art. See, e.g., Remington, The Science and Practice of Pharmacy (21st ed. 2005). Suitable formulations include, for example, powders, pastes, ointments, jellies, waxes, oils, lipids, lipid (cationic or anionic) containing vesicles (such as LIPOFECTIN vesicles), lipid nanoparticles, DNA conjugates, anhydrous absorption pastes, oil-in-water and water-in-oil emulsions, emulsions carbowax (polyethylene glycols of various molecular weights), semi-solid gels, and semi-solid mixtures containing carbowax. Pharmaceutical compositions for oral or parenteral use may be prepared into dosage forms in a unit dose suited to fit a dose of the active ingredients. Such dosage forms in a unit dose include, for example, tablets, pills, capsules, injections (ampoules), suppositories, etc.

In some embodiments wherein cells comprising or modified with the presently disclosed RGN, gRNAs, RGN systems or polynucleotides encoding the same are administered to a subject, the cells are administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the cells described herein using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Physiologically tolerable and pharmaceutically acceptable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions that is effective in the treatment of a particular disorder or condition can depend on the nature of the disorder or condition, and can be determined by standard clinical techniques.

The presently disclosed RGN polypeptides, guide RNAs, RGN systems or polynucleotides encoding the same can be formulated with pharmaceutically acceptable excipients such as carriers, solvents, stabilizers, adjuvants, diluents, etc., depending upon the particular mode of administration and dosage form. In some embodiments, these pharmaceutical compositions are formulated to achieve a physiologically compatible pH, and range from a pH of about 3 to a pH of about 11, about pH 3 to about pH 7, depending on the formulation and route of administration. In some embodiments, the pH can be adjusted to a range from about pH 5.0 to about pH 8. In some embodiments, the compositions can comprise a therapeutically effective amount of at least one compound as described herein, together with one or more pharmaceutically acceptable excipients. In some embodiments, the compositions comprise a combination of the compounds described herein, or include a second active ingredient useful in the treatment or prevention of bacterial growth (for example and without limitation, anti-bacterial or anti-microbial agents), or include a combination of reagents of the present disclosure.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients can include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol), wetting or emulsifying agents, pH buffering substances, and the like.

In some embodiments, the formulations are provided in unit-dose or multi-dose containers, for example sealed ampules and vials, and may be stored in a freeze-dried (lyophilized) condition requiring the addition of the sterile liquid carrier, for example, saline, water-for-injection, a semi-liquid foam, or gel, immediately prior to use. Extemporaneous injection solutions and suspensions may be prepared from sterile powders, granules and tablets of the kind previously described. In some embodiments, the active ingredient is dissolved in a buffered liquid solution that is frozen in a unit-dose or multi-dose container and later thawed for injection or kept/stabilized under refrigeration until use.

The therapeutic agent(s) may be contained in controlled release systems. In order to prolong the effect of a drug, it often is desirable to slow the absorption of the drug from subcutaneous, intrathecal, or intramuscular injection. This may be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. In some embodiments, the use of a long-term sustained release implant may be particularly suitable for treatment of chronic conditions. Long-term sustained release implants are well-known to those of ordinary skill in the art.

Methods of treating a disease in a subject in need thereof are provided herein. The methods comprise administering to a subject in need thereof an effective amount of a presently disclosed RGN polypeptide or active variant or fragment thereof or a polynucleotide encoding the same, a presently disclosed gRNA or a polynucleotide encoding the same, a presently disclosed RGN system, or a cell modified by or comprising any one of these compositions.

In some embodiments, the treatment comprises in vivo gene editing by administering a presently disclosed RGN polypeptide, gRNA, or RGN system or polynucleotide(s) encoding the same. In some embodiments, the treatment comprises ex vivo gene editing wherein cells are genetically modified ex vivo with a presently disclosed RGN polypeptide, gRNA, or RGN system or polynucleotide(s) encoding the same and then the modified cells are administered to a subject. In some embodiments, the genetically modified cells originate from the subject that is then administered the modified cells, and the transplanted cells are referred to herein as autologous. In some embodiments, the genetically modified cells originate from a different subject (i.e., donor) within the same species as the subject that is administered the modified cells (i.e., recipient), and the transplanted cells are referred to herein as allogeneic. In some examples described herein, the cells can be expanded in culture prior to administration to a subject in need thereof.

In some embodiments, the disease to be treated with the presently disclosed compositions is one that can be treated with immunotherapy, such as with a chimeric antigen receptor (CAR) T cell. Such diseases include but are not limited to cancer. In some embodiments, the disease to be treated with the presently disclosed compositions is associated with a causal mutation. As used herein, a "causal mutation" refers to a particular nucleotide, nucleotides, or nucleotide sequence in the genome that contributes to the severity or presence of a disease or disorder in a subject. The correction of the causal mutation leads to the improvement of at least one symptom resulting from a disease or disorder. In some embodiments, the causal mutation is adjacent to a PAM site recognized by an RGN disclosed herein. The causal mutation can be corrected with a presently disclosed RGN or a fusion polypeptide comprising a presently disclosed RGN and a base-editing polypeptide (i.e., a base editor). Non-limiting examples of diseases associated with a causal mutation include cystic fibrosis, Hurler syndrome, Friedreich's Ataxia, Huntington's Disease, and sickle cell disease. In some embodiments, the disease to be treated with the presently disclosed RGNs is a disease listed in Table 11. Additional non-limiting examples of disease-associated genes and mutations are available from McKusick-Nathans Institute of Genetic Medicine, Johns Hopkins University (Baltimore, Md.) and National Center for Biotechnology Information, National Library of Medicine (Bethesda, Md.), available on the World Wide Web.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The specific dose may vary depending on one or more of: the particular agent chosen, the dosing regimen to be followed, whether it is administered in combination with other compounds, timing of administration, and the delivery system in which it is carried.

The term "administering" refers to the placement of an active ingredient into a subject, by a method or route that results in at least partial localization of the introduced active ingredient at a desired site, such as a site of injury or repair, such that a desired effect(s) is produced. In those embodiments wherein cells are administered, the cells can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the life time of the patient, i.e., long-term engraftment. For example, in some aspects described herein, an effective amount of photoreceptor cells or retinal progenitor cells is administered via a systemic route of administration, such as an intraperitoneal or intravenous route.

In some embodiments, the administering comprises administering by viral delivery. In some embodiments, the administering comprises administering by electroporation. In some embodiments, the administering comprises administering by nanoparticle delivery. In some embodiments, the administering comprises administering by liposome delivery. Any effective route of administration can be used to administer an effective amount of a pharmaceutical composition described herein. In some embodiments, the administering comprises administering by a method selected from the group consisting of: intravenously, subcutaneously, intramuscularly, orally, rectally, by aerosol, parenterally, ophthalmicly, pulmonarily, transdermally, vaginally, otically, nasally, and by topical administration, or any combination thereof. In some embodiments, for the delivery of cells, administration by injection or infusion is used.

As used herein, the term "subject" refers to any individual for whom diagnosis, treatment or therapy is desired. In some embodiments, the subject is an animal. In some embodiments, the subject is a mammal. In some embodiments, the subject is a human being.

The efficacy of a treatment can be determined by the skilled clinician. However, a treatment is considered an "effective treatment," if any one or all of the signs or symptoms of a disease or disorder are altered in a beneficial manner (e.g., decreased by at least 10%), or other clinically accepted symptoms or markers of disease are improved or ameliorated. Efficacy can also be measured by failure of an individual to worsen as assessed by hospitalization or need for medical interventions (e.g., progression of the disease is halted or at least slowed). Methods of measuring these indicators are known to those of skill in the art. Treatment includes: (1) inhibiting the disease, e.g., arresting, or slowing the progression of symptoms; or (2) relieving the disease, e.g., causing regression of symptoms; and (3) preventing or reducing the likelihood of the development of symptoms.

A. Modifying Causal Mutations Using Base-Editing

An example of a genetically inherited disease which could be corrected using an approach that relies on an RGN-base editor fusion protein of the invention is Hurler Syndrome. Hurler Syndrome, also known as MPS-1, is the result of a deficiency of α-L-iduronidase (IDUA) resulting in a lysosomal storage disease characterized at the molecular level by the accumulation of dermatan sulfate and heparan sulfate in lysosomes. This disease is generally an inherited genetic disorder caused by mutations in the IDUA gene encoding α-L-iduronidase. Common IDUA mutations are W402X and Q70X, both nonsense mutations resulting in premature termination of translation. Such mutations are well addressed by precise genome editing (PGE) approaches, since reversion of a single nucleotide, for example by a base-editing approach, would restore the wild-type coding sequence and result in protein expression controlled by the endogenous regulatory mechanisms of the genetic locus. Additionally, since heterozygotes are known to be asymptomatic, a PGE therapy that targets one of these mutations would be useful to a large proportion of patients with this disease, as only one of the mutated alleles needs to be corrected (Bunge et al. (1994) Hum. Mol. Genet. 3(6): 861-866, herein incorporated by reference).

Current treatments for Hurler Syndrome include enzyme replacement therapy and bone marrow transplants (Vellodi et al. (1997) Arch. Dis. Child. 76(2): 92-99; Peters et al. (1998) Blood 91(7): 2601-2608, herein incorporated by reference). While enzyme replacement therapy has had a dramatic effect on the survival and quality of life of Hurler Syndrome patients, this approach requires costly and time-consuming weekly infusions. Additional approaches include the delivery of the IDUA gene on an expression vector or the insertion of the gene into a highly expressed locus such as that of serum albumin (U.S. Pat. No. 9,956,247, herein incorporated by reference). However, these approaches do not restore the original IDUA locus to the correct coding sequence. A genome-editing strategy would have a number of advantages, most notably that regulation of gene expression would be controlled by the natural mechanisms present in healthy individuals. Additionally, using base editing does not necessitate causing a double stranded DNA breaks, which could lead to large chromosomal rearrangements, cell death, or oncogenecity by the disruption of tumor suppression mechanisms. A general strategy may be directed toward using RGN-base editor fusion proteins of the invention to target and correct certain disease-causing mutations in the human genome. It will be appreciated that similar approaches to target diseases that can be corrected by base-editing may also be pursued. It will be further appreciated that similar approaches to target disease-causing mutations in other species, particularly common household pets or livestock, can also be deployed using the RGNs of the invention. Common household pets and livestock include dogs, cats, horses, pigs, cows, sheep, chickens, donkeys, snakes, ferrets, and fish including salmon and shrimp.

B. Modifying Causal Mutations by Targeted Deletion

RGNs of the invention could also be useful in human therapeutic approaches where the causal mutation is more complicated. For example, some diseases such as Friedreich's Ataxia and Huntington's Disease are the result of a significant increase in repeats of a three nucleotide motif at a particular region of a gene, which affects the ability of the expressed protein to function or to be expressed. Friedreich's Ataxia (FRDA) is an autosomal recessive disease resulting in progressive degeneration of nervous tissue in the spinal cord. Reduced levels of the frataxin (FXN) protein in the mitochondria cause oxidative damages and iron deficiencies at the cellular level. The reduced FXN expression has been linked to a GAA triplet expansion within the intron 1 of the somatic and germline FXN gene. In FRDA patients, the GAA repeat frequently consists of more than 70, sometimes even more than 1000 (most commonly 600-900) triplets, whereas unaffected individuals have about 40 repeats or less (Pandolfo et al. (2012) Handbook of Clinical Neurology 103: 275-294; Campuzano et al. (1996) Science 271: 1423-1427; Pandolfo (2002) Adv. Exp. Med. Biol. 516: 99-118; all herein incorporated by reference).

The expansion of the trinucleotide repeat sequence causing Friedreich's Ataxia (FRDA) occurs in a defined genetic locus within the FXN gene, referred to as the FRDA instability region. RNA guided nucleases (RGNs) may be used for excising the instability region in FRDA patient cells. This approach requires 1) an RGN and guide RNA sequence that can be programmed to target the allele in the human genome; and 2) a delivery approach for the RGN and guide sequence. Many nucleases used for genome editing, such as the commonly used Cas9 nuclease from *S. pyogenes* (SpCas9), are too large to be packaged into adeno-associated viral (AAV) vectors, especially when considering the length of the SpCas9 gene and the guide RNA in addition to other genetic elements required for functional expression cassettes. This makes an approach using SpCas9 more difficult. Certain RNA guided nucleases of the invention are well suited for packaging into an AAV vector along with a guide RNA. Packing two guide RNAs would likely require a second vector, but this approach still compares favorably to what would be required of a larger nuclease such as SpCas9, which may require splitting the protein sequence between two vectors. The present invention encompasses a strategy using RGNs of the invention in which a region of genomic instability is removed. Such a strategy is applicable to other diseases and disorders which have a similar genetic basis, such as Huntington's Disease. Similar strategies using RGNs of the invention may also be applicable to similar diseases and disorders in non-human animals of agronomic or economic importance, including dogs, cats, horses, pigs, cows, sheep, chickens, donkeys, snakes, ferrets, and fish including salmon and shrimp.

C. Modifying Causal Mutations by Targeted Mutagenesis

RGNs of the invention could also be to introduce disruptive mutations that may result in a beneficial effect. Genetic defects in the genes encoding hemoglobin, particularly the beta globin chain (the HBB gene), can be responsible for a number of diseases known as hemoglobinopathies, including sickle cell anemia and thalassemias.

In adult humans, hemoglobin is a heterotetramer comprising two alpha (α)-like globin chains and two beta (β)-like globin chains and 4 heme groups. In adults the α2β2 tetramer is referred to as Hemoglobin A (HbA) or adult hemoglobin. Typically, the alpha and beta globin chains are synthesized in an approximate 1:1 ratio and this ratio seems to be critical in terms of hemoglobin and red blood cell (RBC) stabilization. In a developing fetus, a different form of hemoglobin, fetal hemoglobin (HbF), is produced which has a higher binding affinity for oxygen than Hemoglobin A such that oxygen can be delivered to the baby's system via the mother's blood stream. Fetal hemoglobin also contains two α globin chains, but in place of the adult β-globin chains, it has two fetal gamma (γ)-globin chains (i.e., fetal hemoglobin is α2γ2). The regulation of the switch from production of gamma- to beta-globin is quite complex, and primarily involves a down-regulation of gamma globin transcription with a simultaneous up-regulation of beta globin transcription. At approximately 30 weeks of gestation, the synthesis of gamma globin in the fetus starts to drop while the production of beta globin increases. By approximately 10 months of age, the newborn's hemoglobin is nearly all α2β2 although some HbF persists into adulthood (approximately 1-3% of total hemoglobin). In the majority of patients with hemoglobinopathies, the genes encoding gamma globin remain present, but expression is relatively low due to normal gene repression occurring around parturition as described above.

Sickle cell disease is caused by a V6E mutation in the β globin gene (HBB) (a GAG to GTG at the DNA level), where the resultant hemoglobin is referred to as "hemoglobinS" or "HbS." Under lower oxygen conditions, HbS molecules aggregate and form fibrous precipitates. These aggregates cause the abnormality or 'sickling' of the RBCs, resulting in a loss of flexibility of the cells. The sickling RBCs are no longer able to squeeze into the capillary beds and can result in vaso-occlusive crisis in sickle cell patients. In addition, sickled RBCs are more fragile than normal RBCs, and tend towards hemolysis, eventually leading to anemia in the patient.

Treatment and management of sickle cell patients is a life-long proposition involving antibiotic treatment, pain management and transfusions during acute episodes. One approach is the use of hydroxyurea, which exerts its effects in part by increasing the production of gamma globin. Long term side effects of chronic hydroxyurea therapy are still unknown, however, and treatment gives unwanted side effects and can have variable efficacy from patient to patient. Despite an increase in the efficacy of sickle cell treatments, the life expectancy of patients is still only in the mid to late 50's and the associated morbidities of the disease have a profound impact on a patient's quality of life.

Thalassemias (alpha thalassemias and beta thalassemia) are also diseases relating to hemoglobin and typically involve a reduced expression of globin chains. This can occur through mutations in the regulatory regions of the genes or from a mutation in a globin coding sequence that results in reduced expression or reduced levels or functional globin protein. Treatment of thalassemias usually involves blood transfusions and iron chelation therapy. Bone marrow transplants are also being used for treatment of people with severe thalassemias if an appropriate donor can be identified, but this procedure can have significant risks.

One approach that has been proposed for the treatment of both sickle cell disease (SCD) and beta thalassemias is to increase the expression of gamma globin so that HbF functionally replaces the aberrant adult hemoglobin. As mentioned above, treatment of SCD patients with hydroxyurea is thought to be successful in part due to its effect on increasing gamma globin expression (DeSimone (1982) Proc Nat'l Acad Sci USA 79(14):4428-31; Ley, et al., (1982) N. Engl. J. Medicine, 307: 1469-1475; Ley, et al., (1983) Blood 62: 370-380; Constantoulakis et al., (1988) Blood 72(6):1961-1967, all herein incorporated by reference). Increasing the expression of HbF involves identification of genes whose products play a role in the regulation of gamma globin expression. One such gene is BCL11A. BCL11A encodes a zinc finger protein that expressed in adult erythroid precursor cells, and down-regulation of its expression leads to an increase in gamma globin expression (Sankaran et at (2008) Science 322: 1839, herein incorporated by reference). Use of an inhibitory RNA targeted to the BCL11A gene has been proposed (e.g., U.S. Patent Publication 2011/0182867, herein incorporated by reference) but this technology has several potential drawbacks, including that complete knock down may not be achieved, delivery of such RNAs may be problematic, and the RNAs must be present continuously, requiring multiple treatments for life.

RGNs of the invention may be used to target the BCL11A enhancer region to disrupt expression of BCL11A, thereby increasing gamma globin expression. This targeted disruption can be achieved by non-homologous end joining (NHEJ), whereby an RGN of the invention targets to a particular sequence within the BCL11A enhancer region, makes a double-stranded break, and the cell's machinery repairs the break, typically simultaneously introducing deleterious mutations. Similar to what is described for other disease targets, RGNs of the invention may have advantages over other known RGNs due to their relatively small size, which enables packaging expression cassettes for the RGN and its guide RNA into a single AAV vector for in vivo delivery. Similar strategies using RGNs of the invention may also be applicable to similar diseases and disorders in both humans and in non-human animals of agronomic or economic importance.

X. Cells Comprising a Polynucleotide Genetic Modification

Provided herein are cells and organisms comprising a target sequence of interest that has been modified using a process mediated by an RGN, crRNA, and/or tracrRNA as described herein. In some of these embodiments, the RGN comprises the amino acid sequence of SEQ ID NOs: 1, 8, 15, 22, 29, 36, 43, 50, 56, 63, 70, 76, 83, 89, 96, 103, 110, 117, 123, or 570-579, or an active variant or fragment thereof. In various embodiments, the guide RNA comprises a CRISPR repeat sequence comprising the nucleotide sequence of SEQ ID NOs: 2, 9, 16, 23, 30, 37, 44, 51, 57, 64, 71, 77, 84, 90, 97, 104, 111, 118, or 124, or an active variant or fragment thereof. In particular embodiments, the guide RNA comprises a tracrRNA comprising the nucleotide sequence of SEQ ID NOs: 3, 10, 17, 24, 31, 38, 45, 52, 58, 65, 72, 78, 85, 91, 98, 105, 112, 119, or 125, or an active variant or fragment thereof. The guide RNA of the system can be a single guide RNA or a dual-guide RNA.

The modified cells can be eukaryotic (e.g., mammalian, plant, insect cell) or prokaryotic. Also provided are organelles and embryos comprising at least one nucleotide sequence that has been modified by a process utilizing an RGN, crRNA, and/or tracrRNA as described herein. The genetically modified cells, organisms, organelles, and embryos can be heterozygous or homozygous for the modified nucleotide sequence.

The chromosomal modification of the cell, organism, organelle, or embryo can result in altered expression (up-regulation or down-regulation), inactivation, or the expression of an altered protein product or an integrated sequence. In those embodiments wherein the chromosomal modification results in either the inactivation of a gene or the expression of a non-functional protein product, the genetically modified cell, organism, organelle, or embryo is referred to as a "knock out". The knock out phenotype can be the result of a deletion mutation (i.e., deletion of at least one nucleotide), an insertion mutation (i.e., insertion of at least one nucleotide), or a nonsense mutation (i.e., substitution of at least one nucleotide such that a stop codon is introduced).

Alternatively, the chromosomal modification of a cell, organism, organelle, or embryo can produce a "knock in", which results from the chromosomal integration of a nucleotide sequence that encodes a protein. In some of these embodiments, the coding sequence is integrated into the chromosome such that the chromosomal sequence encoding the wild-type protein is inactivated, but the exogenously introduced protein is expressed.

In other embodiments, the chromosomal modification results in the production of a variant protein product. The expressed variant protein product can have at least one amino acid substitution and/or the addition or deletion of at least one amino acid. The variant protein product encoded by the altered chromosomal sequence can exhibit modified characteristics or activities when compared to the wild-type protein, including but not limited to altered enzymatic activity or substrate specificity.

In yet other embodiments, the chromosomal modification can result in an altered expression pattern of a protein. As a non-limiting example, chromosomal alterations in the regulatory regions controlling the expression of a protein product can result in the overexpression or downregulation of the protein product or an altered tissue or temporal expression pattern.

The cells that have been modified can be grown into an organism, such as a plant, in accordance with conventional ways. See, for example, McCormick et al. (1986) *Plant Cell Reports* 5:81-84. These plants may then be grown, and either pollinated with the same modified strain or different strains, and the resulting hybrid having the genetic modification. The present invention provides genetically modified seed. Progeny, variants, and mutants of the regenerated plants are also included within the scope of the invention, provided that these parts comprise the genetic modification. Further provided is a processed plant product or byproduct that retains the genetic modification, including for example, soymeal.

The methods provided herein may be used for modification of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, *papaya*, cashew, macadamia, almond, oats, vegetables, ornamentals, and conifers.

Vegetables include, but are not limited to, tomatoes, lettuce, green beans, lima beans, peas, and members of the genus *Curcumis* such as cucumber, cantaloupe, and musk melon. Ornamentals include, but are not limited to, azalea, *hydrangea*, hibiscus, roses, tulips, daffodils, petunias, carnation, poinsettia, and *chrysanthemum*. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape, etc.).

The methods provided herein can also be used to genetically modify any prokaryotic species, including but not limited to, archaea and bacteria (e.g., *Bacillus* sp., *Klebsiella* sp. *Streptomyces* sp., *Rhizobium* sp., *Escherichia* sp., *Pseudomonas* sp., *Salmonella* sp., *Shigella* sp., *Vibrio* sp., *Yersinia* sp., *Mycoplasma* sp., *Agrobacterium*, *Lactobacillus* sp.).

The methods provided herein can be used to genetically modify any eukaryotic species or cells therefrom, including but not limited to animals (e.g., mammals, insects, fish, birds, and reptiles), fungi, amoeba, algae, and yeast. In some embodiments, the cell that is modified by the presently disclosed methods include cells of hematopoietic origin, such as cells of the immune system including but not limited to B cells, T cells, natural killer (NK) cells, pluripotent stem cells, induced pluripotent stem cells, chimeric antigen receptor T (CAR-T) cells, monocytes, macrophages, and dendritic cells.

Cells that have been modified may be introduced into an organism. These cells could have originated from the same organism (e.g., person) in the case of autologous cellular transplants, wherein the cells are modified in an ex vivo approach. Alternatively, the cells originated from another organism within the same species (e.g., another person) in the case of allogeneic cellular transplants.

The article "a" and "an" are used herein to refer to one or more than one (i.e., to at least one) of the grammatical object of the article. By way of example, "a polypeptide" means one or more polypeptides.

All publications and patent applications mentioned in the specification are indicative of the level of those skilled in the art to which this disclosure pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended embodiments.

Non-limiting embodiments include:

1. A nucleic acid molecule comprising a polynucleotide encoding an RNA-guided nuclease (RGN) polypeptide, wherein said polynucleotide comprises a nucleotide sequence encoding an RGN polypeptide comprising an amino acid sequence having at least 90% sequence identity to any one of SEQ ID NOs: 1, 8, 15, 22, 29, 36, 43, 50, 56, 63, 70, 76, 83, 89, 96, 103, 110, 117, 123, and 570-579;
   wherein said RGN polypeptide is capable of binding a target DNA sequence in an RNA-guided sequence specific manner when bound to a guide RNA (gRNA) capable of hybridizing to said target DNA sequence, and
   wherein said polynucleotide encoding an RGN polypeptide is operably linked to a promoter heterologous to said polynucleotide.
2. The nucleic acid molecule of embodiment 1, wherein said RGN polypeptide comprises an amino acid sequence having at least 95% sequence identity to any one of SEQ ID NOs: 1, 8, 15, 22, 29, 36, 43, 50, 56, 63, 70, 76, 83, 89, 96, 103, 110, 117, 123, and 570-579.
3. The nucleic acid molecule of embodiment 1, wherein said RGN polypeptide comprises an amino acid sequence having 100% sequence identity to any one of SEQ ID NOs: 1, 8, 15, 22, 29, 36, 43, 50, 56, 63, 70, 76, 83, 89, 96, 103, 110, 117, 123, and 570-579.
4. The nucleic acid molecule of embodiment 1, wherein said RGN polypeptide has at least 90% sequence identity to SEQ ID NO: 63 and has an isoleucine at an amino acid position corresponding to 305, a valine at an amino acid position corresponding to 328, a leucine at an amino acid position corresponding to 366, a threonine at an amino acid position corresponding to 368, and a valine at an amino acid position corresponding to 405 of SEQ ID NO: 63.
5. The nucleic acid molecule of any one of embodiments 1-4, wherein said RGN polypeptide is capable of cleaving said target DNA sequence upon binding.
6. The nucleic acid molecule of embodiment 5, wherein said RGN polypeptide is capable of generating a double-stranded break.
7. The nucleic acid molecule of embodiment 5, wherein said RGN polypeptide is capable of generating a single-stranded break.
8. The nucleic acid molecule of any one of embodiments 1-4, wherein said RGN polypeptide is nuclease inactive or is a nickase.
9. The nucleic acid molecule of any one of embodiments 1-8, wherein the RGN polypeptide is operably fused to a base-editing polypeptide.
10. The nucleic acid molecule of embodiment 9, wherein the base-editing polypeptide is a deaminase.
11. The nucleic acid molecule of embodiment 10, wherein the deaminase is a cytidine deaminase or an adenine deaminase.
12. The nucleic acid molecule of any one of embodiments 1-11, wherein the RGN polypeptide comprises one or more nuclear localization signals.
13. The nucleic acid molecule of any one of embodiments 1-12, wherein the RGN polypeptide is codon optimized for expression in a eukaryotic cell.
14. The nucleic acid molecule of any one of embodiments 1-13, wherein said target DNA sequence is located adjacent to a protospacer adjacent motif (PAM).
15. A vector comprising the nucleic acid molecule of any one of embodiments 1-14.
16. The vector of embodiment 15, further comprising at least one nucleotide sequence encoding said gRNA capable of hybridizing to said target DNA sequence.
17. The vector of embodiment 16, wherein the guide RNA is selected from the group consisting of:
   a) a guide RNA comprising:
      i) a CRISPR RNA comprising a CRISPR repeat sequence having at least 90% sequence identity to SEQ ID NO: 2; and
      ii) a tracrRNA having at least 90% sequence identity to SEQ ID NO: 3;
      wherein said RGN polypeptide comprises an amino acid sequence having at least 90% sequence identity to SEQ ID NO: 1;
   b) a guide RNA comprising:
      i) a CRISPR RNA comprising a CRISPR repeat sequence having at least 90% sequence identity to SEQ ID NO: 9; and
      ii) a tracrRNA having at least 90% sequence identity to SEQ ID NO: 10;
      wherein said RGN polypeptide comprises an amino acid sequence having at least 90% sequence identity to SEQ ID NO: 8;
   c) a guide RNA comprising:
      i) a CRISPR RNA comprising a CRISPR repeat sequence having at least 90% sequence identity to SEQ ID NO: 16; and
      ii) a tracrRNA having at least 90% sequence identity to SEQ ID NO: 17;
      wherein said RGN polypeptide comprises an amino acid sequence having at least 90% sequence identity to SEQ ID NO: 15;
   d) a guide RNA comprising:
      i) a CRISPR RNA comprising a CRISPR repeat sequence having at least 90% sequence identity to SEQ ID NO: 23; and
      ii) a tracrRNA having at least 90% sequence identity to SEQ ID NO: 24;
      wherein said RGN polypeptide comprises an amino acid sequence having at least 90% sequence identity to SEQ ID NO: 22;
   e) a guide RNA comprising:
      i) a CRISPR RNA comprising a CRISPR repeat sequence having at least 90% sequence identity to SEQ ID NO: 30; and
      ii) a tracrRNA having at least 90% sequence identity to SEQ ID NO: 31;
      wherein said RGN polypeptide comprises an amino acid sequence having at least 90% sequence identity to SEQ ID NO: 29;

f) a guide RNA comprising:
  i) a CRISPR RNA comprising a CRISPR repeat sequence having at least 90% sequence identity to SEQ ID NO: 37; and
  ii) a tracrRNA having at least 90% sequence identity to SEQ ID NO: 38;
  wherein said RGN polypeptide comprises an amino acid sequence having at least 90% sequence identity to SEQ ID NO: 36;
g) a guide RNA comprising:
  i) a CRISPR RNA comprising a CRISPR repeat sequence having at least 90% sequence identity to SEQ ID NO: 44; and
  ii) a tracrRNA having at least 90% sequence identity to SEQ ID NO: 45;
  wherein said RGN polypeptide comprises an amino acid sequence having at least 90% sequence identity to SEQ ID NO: 43;
h) a guide RNA comprising:
  i) a CRISPR RNA comprising a CRISPR repeat sequence having at least 90% sequence identity to SEQ ID NO: 51; and
  ii) a tracrRNA having at least 90% sequence identity to SEQ ID NO: 52;
  wherein said RGN polypeptide comprises an amino acid sequence having at least 90% sequence identity to SEQ ID NO: 50;
i) a guide RNA comprising:
  i) a CRISPR RNA comprising a CRISPR repeat sequence having at least 90% sequence identity to SEQ ID NO: 57; and
  ii) a tracrRNA having at least 90% sequence identity to SEQ ID NO: 58;
  wherein said RGN polypeptide comprises an amino acid sequence having at least 90% sequence identity to SEQ ID NO: 56;
j) a guide RNA comprising:
  i) a CRISPR RNA comprising a CRISPR repeat sequence having at least 90% sequence identity to SEQ ID NO: 64; and
  ii) a tracrRNA having at least 90% sequence identity to SEQ ID NO: 65;
  wherein said RGN polypeptide comprises an amino acid sequence having at least 90% sequence identity to any one of SEQ ID NOs: 63 and 570-579;
k) a guide RNA comprising:
  i) a CRISPR RNA comprising a CRISPR repeat sequence having at least 90% sequence identity to SEQ ID NO: 71; and
  ii) a tracrRNA having at least 90% sequence identity to SEQ ID NO: 72;
  wherein said RGN polypeptide comprises an amino acid sequence having at least 90% sequence identity to SEQ ID NO: 70;
l) a guide RNA comprising:
  i) a CRISPR RNA comprising a CRISPR repeat sequence having at least 90% sequence identity to SEQ ID NO: 77; and
  ii) a tracrRNA having at least 90% sequence identity to SEQ ID NO: 78;
  wherein said RGN polypeptide comprises an amino acid sequence having at least 90% sequence identity to SEQ ID NO: 76;
m) a guide RNA comprising:
  i) a CRISPR RNA comprising a CRISPR repeat sequence having at least 90% sequence identity to SEQ ID NO: 84; and
  ii) a tracrRNA having at least 90% sequence identity to SEQ ID NO: 85;
  wherein said RGN polypeptide comprises an amino acid sequence having at least 90% sequence identity to SEQ ID NO: 83;
n) a guide RNA comprising:
  i) a CRISPR RNA comprising a CRISPR repeat sequence having at least 90% sequence identity to SEQ ID NO: 90; and
  ii) a tracrRNA having at least 90% sequence identity to SEQ ID NO: 91;
  wherein said RGN polypeptide comprises an amino acid sequence having at least 90% sequence identity to SEQ ID NO: 89;
o) a guide RNA comprising:
  i) a CRISPR RNA comprising a CRISPR repeat sequence having at least 90% sequence identity to SEQ ID NO: 97; and
  ii) a tracrRNA having at least 90% sequence identity to SEQ ID NO: 98;
  wherein said RGN polypeptide comprises an amino acid sequence having at least 90% sequence identity to SEQ ID NO: 96;
p) a guide RNA comprising:
  i) a CRISPR RNA comprising a CRISPR repeat sequence having at least 90% sequence identity to SEQ ID NO: 104; and
  ii) a tracrRNA having at least 90% sequence identity to SEQ ID NO: 105;
  wherein said RGN polypeptide comprises an amino acid sequence having at least 90% sequence identity to SEQ ID NO: 103;
q) a guide RNA comprising:
  i) a CRISPR RNA comprising a CRISPR repeat sequence having at least 90% sequence identity to SEQ ID NO: 111; and
  ii) a tracrRNA having at least 90% sequence identity to SEQ ID NO: 112;
  wherein said RGN polypeptide comprises an amino acid sequence having at least 90% sequence identity to SEQ ID NO: 110;
r) a guide RNA comprising:
  i) a CRISPR RNA comprising a CRISPR repeat sequence having at least 90% sequence identity to SEQ ID NO: 118; and
  ii) a tracrRNA having at least 90% sequence identity to SEQ ID NO: 119;
  wherein said RGN polypeptide comprises an amino acid sequence having at least 90% sequence identity to SEQ ID NO: 117;
s) a guide RNA comprising:
  i) a CRISPR RNA comprising a CRISPR repeat sequence having at least 90% sequence identity to SEQ ID NO: 124; and
  ii) a tracrRNA having at least 90% sequence identity to SEQ ID NO: 125;
  wherein said RGN polypeptide comprises an amino acid sequence having at least 90% sequence identity to SEQ ID NO: 123; and
t) a guide RNA comprising:
  i) a CRISPR RNA comprising a CRISPR repeat sequence having at least 90% sequence identity to SEQ ID NO: 84; and
  ii) a tracrRNA having at least 90% sequence identity to SEQ ID NO: 78;

wherein said RGN polypeptide comprises an amino acid sequence having at least 90% sequence identity to SEQ ID NO: 83.

18. The vector of embodiment 16, wherein the guide RNA is selected from the group consisting of:
a) a guide RNA comprising:
  i) a CRISPR RNA comprising a CRISPR repeat sequence having at least 95% sequence identity to SEQ ID NO: 2; and
  ii) a tracrRNA having at least 95% sequence identity to SEQ ID NO: 3;
  wherein said RGN polypeptide comprises an amino acid sequence having at least 95% sequence identity to SEQ ID NO: 1;
b) a guide RNA comprising:
  i) a CRISPR RNA comprising a CRISPR repeat sequence having at least 95% sequence identity to SEQ ID NO: 9; and
  ii) a tracrRNA having at least 95% sequence identity to SEQ ID NO: 10;
  wherein said RGN polypeptide comprises an amino acid sequence having at least 95% sequence identity to SEQ ID NO: 8;
c) a guide RNA comprising:
  i) a CRISPR RNA comprising a CRISPR repeat sequence having at least 95% sequence identity to SEQ ID NO: 16; and
  ii) a tracrRNA having at least 95% sequence identity to SEQ ID NO: 17;
  wherein said RGN polypeptide comprises an amino acid sequence having at least 95% sequence identity to SEQ ID NO: 15;
d) a guide RNA comprising:
  i) a CRISPR RNA comprising a CRISPR repeat sequence having at least 95% sequence identity to SEQ ID NO: 23; and
  ii) a tracrRNA having at least 95% sequence identity to SEQ ID NO: 24;
  wherein said RGN polypeptide comprises an amino acid sequence having at least 95% sequence identity to SEQ ID NO: 22;
e) a guide RNA comprising:
  i) a CRISPR RNA comprising a CRISPR repeat sequence having at least 95% sequence identity to SEQ ID NO: 30; and
  ii) a tracrRNA having at least 95% sequence identity to SEQ ID NO: 31;
  wherein said RGN polypeptide comprises an amino acid sequence having at least 95% sequence identity to SEQ ID NO: 29;
f) a guide RNA comprising:
  i) a CRISPR RNA comprising a CRISPR repeat sequence having at least 95% sequence identity to SEQ ID NO: 37; and
  ii) a tracrRNA having at least 95% sequence identity to SEQ ID NO: 38;
  wherein said RGN polypeptide comprises an amino acid sequence having at least 95% sequence identity to SEQ ID NO: 36;
g) a guide RNA comprising:
  i) a CRISPR RNA comprising a CRISPR repeat sequence having at least 95% sequence identity to SEQ ID NO: 44; and
  ii) a tracrRNA having at least 95% sequence identity to SEQ ID NO: 45;
  wherein said RGN polypeptide comprises an amino acid sequence having at least 95% sequence identity to SEQ ID NO: 43;
h) a guide RNA comprising:
  i) a CRISPR RNA comprising a CRISPR repeat sequence having at least 95% sequence identity to SEQ ID NO: 51; and
  ii) a tracrRNA having at least 95% sequence identity to SEQ ID NO: 52;
  wherein said RGN polypeptide comprises an amino acid sequence having at least 95% sequence identity to SEQ ID NO: 50;
i) a guide RNA comprising:
  i) a CRISPR RNA comprising a CRISPR repeat sequence having at least 95% sequence identity to SEQ ID NO: 57; and
  ii) a tracrRNA having at least 95% sequence identity to SEQ ID NO: 58;
  wherein said RGN polypeptide comprises an amino acid sequence having at least 95% sequence identity to SEQ ID NO: 56;
j) a guide RNA comprising:
  i) a CRISPR RNA comprising a CRISPR repeat sequence having at least 95% sequence identity to SEQ ID NO: 64; and
  ii) a tracrRNA having at least 95% sequence identity to SEQ ID NO: 65;
  wherein said RGN polypeptide comprises an amino acid sequence having at least 95% sequence identity to any one of SEQ ID NOs: 63 and 570-579;
k) a guide RNA comprising:
  i) a CRISPR RNA comprising a CRISPR repeat sequence having at least 95% sequence identity to SEQ ID NO: 71; and
  ii) a tracrRNA having at least 95% sequence identity to SEQ ID NO: 72;
  wherein said RGN polypeptide comprises an amino acid sequence having at least 95% sequence identity to SEQ ID NO: 70;
l) a guide RNA comprising:
  i) a CRISPR RNA comprising a CRISPR repeat sequence having at least 95% sequence identity to SEQ ID NO: 77; and
  ii) a tracrRNA having at least 95% sequence identity to SEQ ID NO: 78;
  wherein said RGN polypeptide comprises an amino acid sequence having at least 95% sequence identity to SEQ ID NO: 76;
m) a guide RNA comprising:
  i) a CRISPR RNA comprising a CRISPR repeat sequence having at least 95% sequence identity to SEQ ID NO: 84; and
  ii) a tracrRNA having at least 95% sequence identity to SEQ ID NO: 85;
  wherein said RGN polypeptide comprises an amino acid sequence having at least 95% sequence identity to SEQ ID NO: 83;
n) a guide RNA comprising:
  i) a CRISPR RNA comprising a CRISPR repeat sequence having at least 95% sequence identity to SEQ ID NO: 90; and
  ii) a tracrRNA having at least 95% sequence identity to SEQ ID NO: 91;
  wherein said RGN polypeptide comprises an amino acid sequence having at least 95% sequence identity to SEQ ID NO: 89;

o) a guide RNA comprising:
   i) a CRISPR RNA comprising a CRISPR repeat sequence having at least 95% sequence identity to SEQ ID NO: 97; and
   ii) a tracrRNA having at least 95% sequence identity to SEQ ID NO: 98;
   wherein said RGN polypeptide comprises an amino acid sequence having at least 95% sequence identity to SEQ ID NO: 96;
p) a guide RNA comprising:
   i) a CRISPR RNA comprising a CRISPR repeat sequence having at least 95% sequence identity to SEQ ID NO: 104; and
   ii) a tracrRNA having at least 95% sequence identity to SEQ ID NO: 105;
   wherein said RGN polypeptide comprises an amino acid sequence having at least 95% sequence identity to SEQ ID NO: 103;
q) a guide RNA comprising:
   i) a CRISPR RNA comprising a CRISPR repeat sequence having at least 95% sequence identity to SEQ ID NO: 111; and
   ii) a tracrRNA having at least 95% sequence identity to SEQ ID NO: 112;
   wherein said RGN polypeptide comprises an amino acid sequence having at least 95% sequence identity to SEQ ID NO: 110;
r) a guide RNA comprising:
   i) a CRISPR RNA comprising a CRISPR repeat sequence having at least 95% sequence identity to SEQ ID NO: 118; and
   ii) a tracrRNA having at least 95% sequence identity to SEQ ID NO: 119;
   wherein said RGN polypeptide comprises an amino acid sequence having at least 95% sequence identity to SEQ ID NO: 117;
s) a guide RNA comprising:
   i) a CRISPR RNA comprising a CRISPR repeat sequence having at least 95% sequence identity to SEQ ID NO: 124; and
   ii) a tracrRNA having at least 95% sequence identity to SEQ ID NO: 125;
   wherein said RGN polypeptide comprises an amino acid sequence having at least 95% sequence identity to SEQ ID NO: 123; and
t) a guide RNA comprising:
   i) a CRISPR RNA comprising a CRISPR repeat sequence having at least 95% sequence identity to SEQ ID NO: 84; and
   ii) a tracrRNA having at least 95% sequence identity to SEQ ID NO: 78;
   wherein said RGN polypeptide comprises an amino acid sequence having at least 95% sequence identity to SEQ ID NO: 83.

19. The vector of embodiment 16, wherein the guide RNA is selected from the group consisting of:
a) a guide RNA comprising:
   i) a CRISPR RNA comprising a CRISPR repeat sequence having 100% sequence identity to SEQ ID NO: 2; and
   ii) a tracrRNA having 100% sequence identity to SEQ ID NO: 3;
   wherein said RGN polypeptide comprises an amino acid sequence having 100% sequence identity to SEQ ID NO: 1;
b) a guide RNA comprising:
   i) a CRISPR RNA comprising a CRISPR repeat sequence having 100% sequence identity to SEQ ID NO: 9; and
   ii) a tracrRNA having 100% sequence identity to SEQ ID NO: 10;
   wherein said RGN polypeptide comprises an amino acid sequence having 100% sequence identity to SEQ ID NO: 8;
c) a guide RNA comprising:
   i) a CRISPR RNA comprising a CRISPR repeat sequence having 100% sequence identity to SEQ ID NO: 16; and
   ii) a tracrRNA having 100% sequence identity to SEQ ID NO: 17;
   wherein said RGN polypeptide comprises an amino acid sequence having 100% sequence identity to SEQ ID NO: 15;
d) a guide RNA comprising:
   i) a CRISPR RNA comprising a CRISPR repeat sequence having 100% sequence identity to SEQ ID NO: 23; and
   ii) a tracrRNA having 100% sequence identity to SEQ ID NO: 24;
   wherein said RGN polypeptide comprises an amino acid sequence having 100% sequence identity to SEQ ID NO: 22;
e) a guide RNA comprising:
   i) a CRISPR RNA comprising a CRISPR repeat sequence having 100% sequence identity to SEQ ID NO: 30; and
   ii) a tracrRNA having 100% sequence identity to SEQ ID NO: 31;
   wherein said RGN polypeptide comprises an amino acid sequence having 100% sequence identity to SEQ ID NO: 29;
f) a guide RNA comprising:
   i) a CRISPR RNA comprising a CRISPR repeat sequence having 100% sequence identity to SEQ ID NO: 37; and
   ii) a tracrRNA having 100% sequence identity to SEQ ID NO: 38;
   wherein said RGN polypeptide comprises an amino acid sequence having 100% sequence identity to SEQ ID NO: 36;
g) a guide RNA comprising:
   i) a CRISPR RNA comprising a CRISPR repeat sequence having 100% sequence identity to SEQ ID NO: 44; and
   ii) a tracrRNA having 100% sequence identity to SEQ ID NO: 45;
   wherein said RGN polypeptide comprises an amino acid sequence having 100% sequence identity to SEQ ID NO: 43;
h) a guide RNA comprising:
   i) a CRISPR RNA comprising a CRISPR repeat sequence having 100% sequence identity to SEQ ID NO: 51; and
   ii) a tracrRNA having 100% sequence identity to SEQ ID NO: 52;
   wherein said RGN polypeptide comprises an amino acid sequence having 100% sequence identity to SEQ ID NO: 50;
i) a guide RNA comprising:
   i) a CRISPR RNA comprising a CRISPR repeat sequence having 100% sequence identity to SEQ ID NO: 57; and ii) a tracrRNA having 100% sequence identity to SEQ ID NO: 58;
wherein said RGN polypeptide comprises an amino acid sequence having 100% sequence identity to SEQ ID NO: 56;
j) a guide RNA comprising:
i) a CRISPR RNA comprising a CRISPR repeat sequence having 100% sequence identity to SEQ ID NO: 64; and
ii) a tracrRNA having 100% sequence identity to SEQ ID NO: 65;
wherein said RGN polypeptide comprises an amino acid sequence having 100% sequence identity to any one of SEQ ID NOs: 63 and 570-579;
k) a guide RNA comprising:
i) a CRISPR RNA comprising a CRISPR repeat sequence having 100% sequence identity to SEQ ID NO: 71; and
ii) a tracrRNA having 100% sequence identity to SEQ ID NO: 72;
wherein said RGN polypeptide comprises an amino acid sequence having 100% sequence identity to SEQ ID NO: 70;
l) a guide RNA comprising:
i) a CRISPR RNA comprising a CRISPR repeat sequence having 100% sequence identity to SEQ ID NO: 77; and
ii) a tracrRNA having 100% sequence identity to SEQ ID NO: 78;
wherein said RGN polypeptide comprises an amino acid sequence having 100% sequence identity to SEQ ID NO: 76;
m) a guide RNA comprising:
i) a CRISPR RNA comprising a CRISPR repeat sequence having 100% sequence identity to SEQ ID NO: 84; and
ii) a tracrRNA having 100% sequence identity to SEQ ID NO: 85;
wherein said RGN polypeptide comprises an amino acid sequence having 100% sequence identity to SEQ ID NO: 83;
n) a guide RNA comprising:
i) a CRISPR RNA comprising a CRISPR repeat sequence having 100% sequence identity to SEQ ID NO: 90; and
ii) a tracrRNA having 100% sequence identity to SEQ ID NO: 91;
wherein said RGN polypeptide comprises an amino acid sequence having 100% sequence identity to SEQ ID NO: 89;
o) a guide RNA comprising:
i) a CRISPR RNA comprising a CRISPR repeat sequence having 100% sequence identity to SEQ ID NO: 97; and
ii) a tracrRNA having 100% sequence identity to SEQ ID NO: 98;
wherein said RGN polypeptide comprises an amino acid sequence having 100% sequence identity to SEQ ID NO: 96;
p) a guide RNA comprising:
i) a CRISPR RNA comprising a CRISPR repeat sequence having 100% sequence identity to SEQ ID NO: 104; and
ii) a tracrRNA having 100% sequence identity to SEQ ID NO: 105;
wherein said RGN polypeptide comprises an amino acid sequence having 100% sequence identity to SEQ ID NO: 103;
q) a guide RNA comprising:
i) a CRISPR RNA comprising a CRISPR repeat sequence having 100% sequence identity to SEQ ID NO: 111; and
ii) a tracrRNA having 100% sequence identity to SEQ ID NO: 112;
wherein said RGN polypeptide comprises an amino acid sequence having 100% sequence identity to SEQ ID NO: 110;
r) a guide RNA comprising:
i) a CRISPR RNA comprising a CRISPR repeat sequence having 100% sequence identity to SEQ ID NO: 118; and
ii) a tracrRNA having 100% sequence identity to SEQ ID NO: 119;
wherein said RGN polypeptide comprises an amino acid sequence having 100% sequence identity to SEQ ID NO: 117;
s) a guide RNA comprising:
i) a CRISPR RNA comprising a CRISPR repeat sequence having 100% sequence identity to SEQ ID NO: 124; and
ii) a tracrRNA having 100% sequence identity to SEQ ID NO: 125;
wherein said RGN polypeptide comprises an amino acid sequence having 100% sequence identity to SEQ ID NO: 123; and
t) a guide RNA comprising:
i) a CRISPR RNA comprising a CRISPR repeat sequence having 100% sequence identity to SEQ ID NO: 84; and
ii) a tracrRNA having 100% sequence identity to SEQ ID NO: 78;
wherein said RGN polypeptide comprises an amino acid sequence having 100% sequence identity to SEQ ID NO: 83.

20. The vector of any one of embodiments 16-19, where said gRNA is a single guide RNA.

21. The vector of any one of embodiments 16-19, wherein said gRNA is a dual-guide RNA.

22. A cell comprising the nucleic acid molecule of any one of embodiments 1-14 or the vector of any one of embodiments 15-21.

23. A method for making an RGN polypeptide comprising culturing the cell of embodiment 22 under conditions in which the RGN polypeptide is expressed.

24. A method for making an RGN polypeptide comprising introducing into a cell a heterologous nucleic acid molecule comprising a nucleotide sequence encoding an RNA-guided nuclease (RGN) polypeptide comprising an amino acid sequence having at least 90% sequence identity to any one of SEQ ID NOs: 1, 8, 15, 22, 29, 36, 43, 50, 56, 63, 70, 76, 83, 89, 96, 103, 110, 117, 123, and 570-579;
wherein said RGN polypeptide is capable of binding a target DNA sequence in an RNA-guided sequence specific manner when bound to a guide RNA (gRNA) capable of hybridizing to said target DNA sequence;
and culturing said cell under conditions in which the RGN polypeptide is expressed.

25. The method of embodiment 24, wherein said RGN polypeptide comprises an amino acid sequence having at least 95% sequence identity to any one of SEQ ID NOs: 1, 8, 15, 22, 29, 36, 43, 50, 56, 63, 70, 76, 83, 89, 96, 103, 110, 117, 123, and 570-579.

26. The method of embodiment 24, wherein said RGN polypeptide comprises an amino acid sequence having 100% sequence identity to any one of SEQ ID NOs: 1, 8, 15, 22, 29, 36, 43, 50, 56, 63, 70, 76, 83, 89, 96, 103, 110, 117, 123, and 570-579.

27. The method of embodiment 24, wherein said RGN polypeptide has at least 90% sequence identity to SEQ ID NO: 63 and has an isoleucine at an amino acid position corresponding to 305, a valine at an amino acid position corresponding to 328, a leucine at an amino acid position corresponding to 366, a threonine at an amino acid position corresponding to 368, and a valine at an amino acid position corresponding to 405 of SEQ ID NO: 63.

28. The method of any one of embodiments 23-27, further comprising purifying said RGN polypeptide.

29. The method of any one of embodiments 23-27, wherein said cell further expresses one or more guide RNAs capable of binding to said RGN polypeptide to form an RGN ribonucleoprotein complex.

30. The method of embodiment 29, further comprising purifying said RGN ribonucleoprotein complex.

31. An isolated RNA-guided nuclease (RGN) polypeptide, wherein said RGN polypeptide comprises an amino acid sequence having at least 90% sequence identity to any one of SEQ ID NOs: 1, 8, 15, 22, 29, 36, 43, 50, 56, 63, 70, 76, 83, 89, 96, 103, 110, 117, 123, and 570-579; and
wherein said RGN polypeptide is capable of binding a target DNA sequence of a DNA molecule in an RNA-guided sequence specific manner when bound to a guide RNA (gRNA) capable of hybridizing to said target DNA sequence.

32. The isolated RGN polypeptide of embodiment 31, wherein said RGN polypeptide comprises an amino acid sequence having at least 95% sequence identity to any one of SEQ ID NOs: 1, 8, 15, 22, 29, 36, 43, 50, 56, 63, 70, 76, 83, 89, 96, 103, 110, 117, 123, and 570-579.

33. The isolated RGN polypeptide of embodiment 31, wherein said RGN polypeptide comprises an amino acid sequence having 100% sequence identity to any one of SEQ ID NOs: 1, 8, 15, 22, 29, 36, 43, 50, 56, 63, 70, 76, 83, 89, 96, 103, 110, 117, 123, and 570-579.

34. The isolated RGN polypeptide of embodiment 31, wherein said RGN polypeptide has at least 90% sequence identity to SEQ ID NO: 63 and has an isoleucine at an amino acid position corresponding to 305, a valine at an amino acid position corresponding to 328, a leucine at an amino acid position corresponding to 366, a threonine at an amino acid position corresponding to 368, and a valine at an amino acid position corresponding to 405 of SEQ ID NO: 63.

35. The isolated RGN polypeptide of any one of embodiments 31-34, wherein said RGN polypeptide is capable of cleaving said target DNA sequence upon binding.

36. The isolated RGN polypeptide of embodiment 35, wherein cleavage by said RGN polypeptide generates a double-stranded break.

37. The isolated RGN polypeptide of embodiment 35, wherein cleavage by said RGN polypeptide generates a single-stranded break.

38. The isolated RGN polypeptide of any one of embodiments 31-34, wherein said RGN polypeptide is nuclease inactive or a nickase.

39. The isolated RGN polypeptide of any one of embodiments 31-38, wherein the RGN polypeptide is operably fused to a base-editing polypeptide.

40. The isolated RGN polypeptide of embodiment 39, wherein the base-editing polypeptide is a deaminase.

41. The isolated RGN polypeptide of any one of embodiments 31-40, wherein said target DNA sequence is located adjacent to a protospacer adjacent motif (PAM).

42. The isolated RGN polypeptide of any one of embodiments 31-41, wherein the RGN polypeptide comprises one or more nuclear localization signals.

43. A nucleic acid molecule comprising a polynucleotide encoding a CRISPR RNA (crRNA), wherein said crRNA comprises a spacer sequence and a CRISPR repeat sequence, wherein said CRISPR repeat sequence comprises a nucleotide sequence having at least 90% sequence identity to any one of SEQ ID NOs: 2, 9, 16, 23, 30, 37, 44, 51, 57, 64, 71, 77, 84, 90, 97, 104, 111, 118, and 124;
wherein a guide RNA comprising:
a) said crRNA; and
b) a trans-activating CRISPR RNA (tracrRNA) hybridized to said CRISPR repeat sequence of said crRNA;
is capable of hybridizing to a target DNA sequence in a sequence specific manner through the spacer sequence of said crRNA when said guide RNA is bound to an RNA-guided nuclease (RGN) polypeptide, and
wherein said polynucleotide encoding a crRNA is operably linked to a promoter heterologous to said polynucleotide.

44. The nucleic acid molecule of embodiment 43, wherein said CRISPR repeat sequence comprises a nucleotide sequence having at least 95% sequence identity to any one of SEQ ID NOs: 2, 9, 16, 23, 30, 37, 44, 51, 57, 64, 71, 77, 84, 90, 97, 104, 111, 118, and 124.

45. The nucleic acid molecule of embodiment 43, wherein said CRISPR repeat sequence comprises a nucleotide sequence having 100% sequence identity to any one of SEQ ID NOs: 2, 9, 16, 23, 30, 37, 44, 51, 57, 64, 71, 77, 84, 90, 97, 104, 111, 118, and 124.

46. A vector comprising the nucleic acid molecule of any one of embodiments 43-45.

47. The vector of embodiment 46, wherein said vector further comprises a polynucleotide encoding said tracrRNA.

48. The vector of embodiment 47, wherein said tracrRNA is selected from the group consisting of:
a) a tracrRNA having at least 90% sequence identity to SEQ ID NO: 3, wherein said CRISPR repeat sequence has at least 90% sequence identity to SEQ ID NO: 2;
b) a tracrRNA having at least 90% sequence identity to SEQ ID NO: 10, wherein said CRISPR repeat sequence has at least 90% sequence identity to SEQ ID NO: 9;
c) a tracrRNA having at least 90% sequence identity to SEQ ID NO: 17, wherein said CRISPR repeat sequence has at least 90% sequence identity to SEQ ID NO: 16;
d) a tracrRNA having at least 90% sequence identity to SEQ ID NO: 24, wherein said CRISPR repeat sequence has at least 90% sequence identity to SEQ ID NO: 23;
e) a tracrRNA having at least 90% sequence identity to SEQ ID NO: 31, wherein said CRISPR repeat sequence has at least 90% sequence identity to SEQ ID NO: 30;
f) a tracrRNA having at least 90% sequence identity to SEQ ID NO: 38, wherein said CRISPR repeat sequence has at least 90% sequence identity to SEQ ID NO: 37;

g) a tracrRNA having at least 90% sequence identity to SEQ ID NO: 45, wherein said CRISPR repeat sequence has at least 90% sequence identity to SEQ ID NO: 44;
h) a tracrRNA having at least 90% sequence identity to SEQ ID NO: 52, wherein said CRISPR repeat sequence has at least 90% sequence identity to SEQ ID NO: 51;
i) a tracrRNA having at least 90% sequence identity to SEQ ID NO: 58, wherein said CRISPR repeat sequence has at least 90% sequence identity to SEQ ID NO: 57;
j) a tracrRNA having at least 90% sequence identity to SEQ ID NO: 65, wherein said CRISPR repeat sequence has at least 90% sequence identity to SEQ ID NO: 64;
k) a tracrRNA having at least 90% sequence identity to SEQ ID NO: 72, wherein said CRISPR repeat sequence has at least 90% sequence identity to SEQ ID NO: 71;
l) a tracrRNA having at least 90% sequence identity to SEQ ID NO: 78, wherein said CRISPR repeat sequence has at least 90% sequence identity to SEQ ID NO: 77;
m) a tracrRNA having at least 90% sequence identity to SEQ ID NO: 85, wherein said CRISPR repeat sequence has at least 90% sequence identity to SEQ ID NO: 84;
n) a tracrRNA having at least 90% sequence identity to SEQ ID NO: 91, wherein said CRISPR repeat sequence has at least 90% sequence identity to SEQ ID NO: 90;
o) a tracrRNA having at least 90% sequence identity to SEQ ID NO: 98, wherein said CRISPR repeat sequence has at least 90% sequence identity to SEQ ID NO: 97;
p) a tracrRNA having at least 90% sequence identity to SEQ ID NO: 105, wherein said CRISPR repeat sequence has at least 90% sequence identity to SEQ ID NO: 104;
q) a tracrRNA having at least 90% sequence identity to SEQ ID NO: 112, wherein said CRISPR repeat sequence has at least 90% sequence identity to SEQ ID NO: 111;
r) a tracrRNA having at least 90% sequence identity to SEQ ID NO: 119, wherein said CRISPR repeat sequence has at least 90% sequence identity to SEQ ID NO: 118; and
s) a tracrRNA having at least 90% sequence identity to SEQ ID NO: 125, wherein said CRISPR repeat sequence has at least 90% sequence identity to SEQ ID NO: 124.

49. The vector of embodiment 47, wherein said tracrRNA is selected from the group consisting of:
a) a tracrRNA having at least 95% sequence identity to SEQ ID NO: 3, wherein said CRISPR repeat sequence has at least 95% sequence identity to SEQ ID NO: 2;
b) a tracrRNA having at least 95% sequence identity to SEQ ID NO: 10, wherein said CRISPR repeat sequence has at least 95% sequence identity to SEQ ID NO: 9;
c) a tracrRNA having at least 95% sequence identity to SEQ ID NO: 17, wherein said CRISPR repeat sequence has at least 95% sequence identity to SEQ ID NO: 16;
d) a tracrRNA having at least 95% sequence identity to SEQ ID NO: 24, wherein said CRISPR repeat sequence has at least 95% sequence identity to SEQ ID NO: 23;
e) a tracrRNA having at least 95% sequence identity to SEQ ID NO: 31, wherein said CRISPR repeat sequence has at least 95% sequence identity to SEQ ID NO: 30;
f) a tracrRNA having at least 95% sequence identity to SEQ ID NO: 38, wherein said CRISPR repeat sequence has at least 95% sequence identity to SEQ ID NO: 37;
g) a tracrRNA having at least 95% sequence identity to SEQ ID NO: 45, wherein said CRISPR repeat sequence has at least 95% sequence identity to SEQ ID NO: 44;
h) a tracrRNA having at least 95% sequence identity to SEQ ID NO: 52, wherein said CRISPR repeat sequence has at least 95% sequence identity to SEQ ID NO: 51;
i) a tracrRNA having at least 95% sequence identity to SEQ ID NO: 58, wherein said CRISPR repeat sequence has at least 95% sequence identity to SEQ ID NO: 57;
j) a tracrRNA having at least 95% sequence identity to SEQ ID NO: 65, wherein said CRISPR repeat sequence has at least 95% sequence identity to SEQ ID NO: 64;
k) a tracrRNA having at least 95% sequence identity to SEQ ID NO: 72, wherein said CRISPR repeat sequence has at least 95% sequence identity to SEQ ID NO: 71;
l) a tracrRNA having at least 95% sequence identity to SEQ ID NO: 78, wherein said CRISPR repeat sequence has at least 95% sequence identity to SEQ ID NO: 77;
m) a tracrRNA having at least 95% sequence identity to SEQ ID NO: 85, wherein said CRISPR repeat sequence has at least 95% sequence identity to SEQ ID NO: 84;
n) a tracrRNA having at least 95% sequence identity to SEQ ID NO: 91, wherein said CRISPR repeat sequence has at least 95% sequence identity to SEQ ID NO: 90;
o) a tracrRNA having at least 95% sequence identity to SEQ ID NO: 98, wherein said CRISPR repeat sequence has at least 95% sequence identity to SEQ ID NO: 97;
p) a tracrRNA having at least 95% sequence identity to SEQ ID NO: 105, wherein said CRISPR repeat sequence has at least 95% sequence identity to SEQ ID NO: 104;
q) a tracrRNA having at least 95% sequence identity to SEQ ID NO: 112, wherein said CRISPR repeat sequence has at least 95% sequence identity to SEQ ID NO: 111;
r) a tracrRNA having at least 95% sequence identity to SEQ ID NO: 119, wherein said CRISPR repeat sequence has at least 95% sequence identity to SEQ ID NO: 118; and
s) a tracrRNA having at least 95% sequence identity to SEQ ID NO: 125, wherein said CRISPR repeat sequence has at least 95% sequence identity to SEQ ID NO: 124.

50. The vector of embodiment 47, wherein said tracrRNA is selected from the group consisting of:
a) a tracrRNA having 100% sequence identity to SEQ ID NO: 3, wherein said CRISPR repeat sequence has 100% sequence identity to SEQ ID NO: 2;
b) a tracrRNA having 100% sequence identity to SEQ ID NO: 10, wherein said CRISPR repeat sequence has 100% sequence identity to SEQ ID NO: 9;
c) a tracrRNA having 100% sequence identity to SEQ ID NO: 17, wherein said CRISPR repeat sequence has 100% sequence identity to SEQ ID NO: 16;
d) a tracrRNA having 100% sequence identity to SEQ ID NO: 24, wherein said CRISPR repeat sequence has 100% sequence identity to SEQ ID NO: 23;
e) a tracrRNA having 100% sequence identity to SEQ ID NO: 31, wherein said CRISPR repeat sequence has 100% sequence identity to SEQ ID NO: 30;
f) a tracrRNA having 100% sequence identity to SEQ ID NO: 38, wherein said CRISPR repeat sequence has 100% sequence identity to SEQ ID NO: 37;
g) a tracrRNA having 100% sequence identity to SEQ ID NO: 45, wherein said CRISPR repeat sequence has 100% sequence identity to SEQ ID NO: 44;
h) a tracrRNA having 100% sequence identity to SEQ ID NO: 52, wherein said CRISPR repeat sequence has 100% sequence identity to SEQ ID NO: 51;

i) a tracrRNA having 100% sequence identity to SEQ ID NO: 58, wherein said CRISPR repeat sequence has 100% sequence identity to SEQ ID NO: 57;
j) a tracrRNA having 100% sequence identity to SEQ ID NO: 65, wherein said CRISPR repeat sequence has 100% sequence identity to SEQ ID NO: 64;
k) a tracrRNA having 100% sequence identity to SEQ ID NO: 72, wherein said CRISPR repeat sequence has 100% sequence identity to SEQ ID NO: 71;
l) a tracrRNA having 100% sequence identity to SEQ ID NO: 78, wherein said CRISPR repeat sequence has 100% sequence identity to SEQ ID NO: 77;
m) a tracrRNA having 100% sequence identity to SEQ ID NO: 85, wherein said CRISPR repeat sequence has 100% sequence identity to SEQ ID NO: 84;
n) a tracrRNA having 100% sequence identity to SEQ ID NO: 91, wherein said CRISPR repeat sequence has 100% sequence identity to SEQ ID NO: 90;
o) a tracrRNA having 100% sequence identity to SEQ ID NO: 98, wherein said CRISPR repeat sequence has 100% sequence identity to SEQ ID NO: 97;
p) a tracrRNA having 100% sequence identity to SEQ ID NO: 105, wherein said CRISPR repeat sequence has 100% sequence identity to SEQ ID NO: 104;
q) a tracrRNA having 100% sequence identity to SEQ ID NO: 112, wherein said CRISPR repeat sequence has 100% sequence identity to SEQ ID NO: 111;
r) a tracrRNA having 100% sequence identity to SEQ ID NO: 119, wherein said CRISPR repeat sequence has 100% sequence identity to SEQ ID NO: 118; and
s) a tracrRNA having 100% sequence identity to SEQ ID NO: 125, wherein said CRISPR repeat sequence has 100% sequence identity to SEQ ID NO: 124.

51. The vector of any one of embodiments 47-50, wherein said polynucleotide encoding said crRNA and said polynucleotide encoding said tracrRNA are operably linked to the same promoter and are encoded as a single guide RNA.

52. The vector of any one of embodiments 47-50, wherein said polynucleotide encoding said crRNA and said polynucleotide encoding said tracrRNA are operably linked to separate promoters.

53. The vector of any one of embodiments 46-52, wherein said vector further comprises a polynucleotide encoding said RGN polypeptide.

54. The vector of embodiment 53, wherein said RGN polypeptide is selected from the group consisting of:
a) a RGN polypeptide having at least 90% sequence identity to SEQ ID NO: 1, wherein said CRISPR repeat sequence has at least 90% sequence identity to SEQ ID NO: 2 and said tracrRNA has at least 90% sequence identity to SEQ ID NO: 3;
b) a RGN polypeptide having at least 90% sequence identity to SEQ ID NO: 8, wherein said CRISPR repeat sequence has at least 90% sequence identity to SEQ ID NO: 9 and said tracrRNA has at least 90% sequence identity to SEQ ID NO: 10;
c) a RGN polypeptide having at least 90% sequence identity to SEQ ID NO: 15, wherein said CRISPR repeat sequence has at least 90% sequence identity to SEQ ID NO: 16 and said tracrRNA has at least 90% sequence identity to SEQ ID NO: 17;
d) a RGN polypeptide having at least 90% sequence identity to SEQ ID NO: 22, wherein said CRISPR repeat sequence has at least 90% sequence identity to SEQ ID NO: 23 and said tracrRNA has at least 90% sequence identity to SEQ ID NO: 24;
e) a RGN polypeptide having at least 90% sequence identity to SEQ ID NO: 29, wherein said CRISPR repeat sequence has at least 90% sequence identity to SEQ ID NO: 30 and said tracrRNA has at least 90% sequence identity to SEQ ID NO: 31;
f) a RGN polypeptide having at least 90% sequence identity to SEQ ID NO: 36, wherein said CRISPR repeat sequence has at least 90% sequence identity to SEQ ID NO: 37 and said tracrRNA has at least 90% sequence identity to SEQ ID NO: 38;
g) a RGN polypeptide having at least 90% sequence identity to SEQ ID NO: 43, wherein said CRISPR repeat sequence has at least 90% sequence identity to SEQ ID NO: 44 and said tracrRNA has at least 90% sequence identity to SEQ ID NO: 45;
h) a RGN polypeptide having at least 90% sequence identity to SEQ ID NO: 50, wherein said CRISPR repeat sequence has at least 90% sequence identity to SEQ ID NO: 51 and said tracrRNA has at least 90% sequence identity to SEQ ID NO: 52;
i) a RGN polypeptide having at least 90% sequence identity to SEQ ID NO: 56, wherein said CRISPR repeat sequence has at least 90% sequence identity to SEQ ID NO: 57 and said tracrRNA has at least 90% sequence identity to SEQ ID NO: 58;
j) a RGN polypeptide having at least 90% sequence identity to any one of SEQ ID NO: 63 and 570-579, wherein said CRISPR repeat sequence has at least 90% sequence identity to SEQ ID NO: 64 and said tracrRNA has at least 90% sequence identity to SEQ ID NO: 65;
k) a RGN polypeptide having at least 90% sequence identity to SEQ ID NO: 70, wherein said CRISPR repeat sequence has at least 90% sequence identity to SEQ ID NO: 71 and said tracrRNA has at least 90% sequence identity to SEQ ID NO: 72;
l) a RGN polypeptide having at least 90% sequence identity to SEQ ID NO: 76, wherein said CRISPR repeat sequence has at least 90% sequence identity to SEQ ID NO: 77 and said tracrRNA has at least 90% sequence identity to SEQ ID NO: 78;
m) a RGN polypeptide having at least 90% sequence identity to SEQ ID NO: 83, wherein said CRISPR repeat sequence has at least 90% sequence identity to SEQ ID NO: 84 and said tracrRNA has at least 90% sequence identity to SEQ ID NO: 85;
n) a RGN polypeptide having at least 90% sequence identity to SEQ ID NO: 89, wherein said CRISPR repeat sequence has at least 90% sequence identity to SEQ ID NO: 90 and said tracrRNA has at least 90% sequence identity to SEQ ID NO: 91;
o) a RGN polypeptide having at least 90% sequence identity to SEQ ID NO: 96, wherein said CRISPR repeat sequence has at least 90% sequence identity to SEQ ID NO: 97 and said tracrRNA has at least 90% sequence identity to SEQ ID NO: 98;
p) a RGN polypeptide having at least 90% sequence identity to SEQ ID NO: 103, wherein said CRISPR repeat sequence has at least 90% sequence identity to SEQ ID NO: 104 and said tracrRNA has at least 90% sequence identity to SEQ ID NO: 105;
q) a RGN polypeptide having at least 90% sequence identity to SEQ ID NO: 110, wherein said CRISPR repeat sequence has at least 90% sequence identity to SEQ ID NO: 111 and said tracrRNA has at least 90% sequence identity to SEQ ID NO: 112;
r) a RGN polypeptide having at least 90% sequence identity to SEQ ID NO: 117, wherein said CRISPR repeat sequence has at least 90% sequence identity to SEQ ID NO: 118 and said tracrRNA has at least 90% sequence identity to SEQ ID NO: 119;
s) a RGN polypeptide having at least 90% sequence identity to SEQ ID NO: 123, wherein said CRISPR repeat sequence has at least 90% sequence identity to SEQ ID NO: 124 and said tracrRNA has at least 90% sequence identity to SEQ ID NO: 125; and
t) a RGN polypeptide having at least 90% sequence identity to SEQ ID NO: 83, wherein said CRISPR repeat sequence has at least 90% sequence identity to SEQ ID NO: 84 and said tracrRNA has at least 90% sequence identity to SEQ ID NO: 78.

55. The vector of embodiment 53, wherein said RGN polypeptide is selected from the group consisting of:
a) a RGN polypeptide having at least 95% sequence identity to SEQ ID NO: 1, wherein said CRISPR repeat sequence has at least 95% sequence identity to SEQ ID NO: 2 and said tracrRNA has at least 95% sequence identity to SEQ ID NO: 3;
b) a RGN polypeptide having at least 95% sequence identity to SEQ ID NO: 8, wherein said CRISPR repeat sequence has at least 95% sequence identity to SEQ ID NO: 9 and said tracrRNA has at least 95% sequence identity to SEQ ID NO: 10;
c) a RGN polypeptide having at least 95% sequence identity to SEQ ID NO: 15, wherein said CRISPR repeat sequence has at least 95% sequence identity to SEQ ID NO: 16 and said tracrRNA has at least 95% sequence identity to SEQ ID NO: 17;
d) a RGN polypeptide having at least 95% sequence identity to SEQ ID NO: 22, wherein said CRISPR repeat sequence has at least 95% sequence identity to SEQ ID NO: 23 and said tracrRNA has at least 95% sequence identity to SEQ ID NO: 24;
e) a RGN polypeptide having at least 95% sequence identity to SEQ ID NO: 29, wherein said CRISPR repeat sequence has at least 95% sequence identity to SEQ ID NO: 30 and said tracrRNA has at least 95% sequence identity to SEQ ID NO: 31;
f) a RGN polypeptide having at least 95% sequence identity to SEQ ID NO: 36, wherein said CRISPR repeat sequence has at least 95% sequence identity to SEQ ID NO: 37 and said tracrRNA has at least 95% sequence identity to SEQ ID NO: 38;
g) a RGN polypeptide having at least 95% sequence identity to SEQ ID NO: 43, wherein said CRISPR repeat sequence has at least 95% sequence identity to SEQ ID NO: 44 and said tracrRNA has at least 95% sequence identity to SEQ ID NO: 45;
h) a RGN polypeptide having at least 95% sequence identity to SEQ ID NO: 50, wherein said CRISPR repeat sequence has at least 95% sequence identity to SEQ ID NO: 51 and said tracrRNA has at least 95% sequence identity to SEQ ID NO: 52;
i) a RGN polypeptide having at least 95% sequence identity to SEQ ID NO: 56, wherein said CRISPR repeat sequence has at least 95% sequence identity to SEQ ID NO: 57 and said tracrRNA has at least 95% sequence identity to SEQ ID NO: 58;
j) a RGN polypeptide having at least 95% sequence identity to any one of SEQ ID NO: 63 and 570-579, wherein said CRISPR repeat sequence has at least 95% sequence identity to SEQ ID NO: 64 and said tracrRNA has at least 95% sequence identity to SEQ ID NO: 65;
k) a RGN polypeptide having at least 95% sequence identity to SEQ ID NO: 70, wherein said CRISPR repeat sequence has at least 95% sequence identity to SEQ ID NO: 71 and said tracrRNA has at least 95% sequence identity to SEQ ID NO: 72;
l) a RGN polypeptide having at least 95% sequence identity to SEQ ID NO: 76, wherein said CRISPR repeat sequence has at least 95% sequence identity to SEQ ID NO: 77 and said tracrRNA has at least 95% sequence identity to SEQ ID NO: 78;
m) a RGN polypeptide having at least 95% sequence identity to SEQ ID NO: 83, wherein said CRISPR repeat sequence has at least 95% sequence identity to SEQ ID NO: 84 and said tracrRNA has at least 95% sequence identity to SEQ ID NO: 85;
n) a RGN polypeptide having at least 95% sequence identity to SEQ ID NO: 89, wherein said CRISPR repeat sequence has at least 95% sequence identity to SEQ ID NO: 90 and said tracrRNA has at least 95% sequence identity to SEQ ID NO: 91;
o) a RGN polypeptide having at least 95% sequence identity to SEQ ID NO: 96, wherein said CRISPR repeat sequence has at least 95% sequence identity to SEQ ID NO: 97 and said tracrRNA has at least 95% sequence identity to SEQ ID NO: 98;
p) a RGN polypeptide having at least 95% sequence identity to SEQ ID NO: 103, wherein said CRISPR repeat sequence has at least 95% sequence identity to SEQ ID NO: 104 and said tracrRNA has at least 95% sequence identity to SEQ ID NO: 105;
q) a RGN polypeptide having at least 95% sequence identity to SEQ ID NO: 110, wherein said CRISPR repeat sequence has at least 95% sequence identity to SEQ ID NO: 111 and said tracrRNA has at least 95% sequence identity to SEQ ID NO: 112;
r) a RGN polypeptide having at least 95% sequence identity to SEQ ID NO: 117, wherein said CRISPR repeat sequence has at least 95% sequence identity to SEQ ID NO: 118 and said tracrRNA has at least 95% sequence identity to SEQ ID NO: 119;
s) a RGN polypeptide having at least 95% sequence identity to SEQ ID NO: 123, wherein said CRISPR repeat sequence has at least 95% sequence identity to SEQ ID NO: 124 and said tracrRNA has at least 95% sequence identity to SEQ ID NO: 125; and
t) a RGN polypeptide having at least 95% sequence identity to SEQ ID NO: 83, wherein said CRISPR repeat sequence has at least 95% sequence identity to SEQ ID NO: 84 and said tracrRNA has at least 95% sequence identity to SEQ ID NO: 78.

56. The vector of embodiment 53, wherein said RGN polypeptide is selected from the group consisting of:
a) a RGN polypeptide having 100% sequence identity to SEQ ID NO: 1, wherein said CRISPR repeat sequence has 100% sequence identity to SEQ ID NO: 2 and said tracrRNA has 100% sequence identity to SEQ ID NO: 3;
b) a RGN polypeptide having 100% sequence identity to SEQ ID NO: 8, wherein said CRISPR repeat sequence has 100% sequence identity to SEQ ID NO: 9 and said tracrRNA has 100% sequence identity to SEQ ID NO: 10;
c) a RGN polypeptide having 100% sequence identity to SEQ ID NO: 15, wherein said CRISPR repeat sequence has 100% sequence identity to SEQ ID NO: 16 and said tracrRNA has 100% sequence identity to SEQ ID NO: 17;
d) a RGN polypeptide having 100% sequence identity to SEQ ID NO: 22, wherein said CRISPR repeat sequence has 100% sequence identity to SEQ ID NO: 23 and said tracrRNA has 100% sequence identity to SEQ ID NO: 24;
e) a RGN polypeptide having 100% sequence identity to SEQ ID NO: 29, wherein said CRISPR repeat sequence has 100% sequence identity to SEQ ID NO: 30 and said tracrRNA has 100% sequence identity to SEQ ID NO: 31;
f) a RGN polypeptide having 100% sequence identity to SEQ ID NO: 36, wherein said CRISPR repeat sequence has 100% sequence identity to SEQ ID NO: 37 and said tracrRNA has 100% sequence identity to SEQ ID NO: 38;
g) a RGN polypeptide having 100% sequence identity to SEQ ID NO: 43, wherein said CRISPR repeat sequence has 100% sequence identity to SEQ ID NO: 44 and said tracrRNA has 100% sequence identity to SEQ ID NO: 45;
h) a RGN polypeptide having 100% sequence identity to SEQ ID NO: 50, wherein said CRISPR repeat sequence has 100% sequence identity to SEQ ID NO: 51 and said tracrRNA has 100% sequence identity to SEQ ID NO: 52;
i) a RGN polypeptide having 100% sequence identity to SEQ ID NO: 56, wherein said CRISPR repeat sequence has 100% sequence identity to SEQ ID NO: 57 and said tracrRNA has 100% sequence identity to SEQ ID NO: 58;
j) a RGN polypeptide having 100% sequence identity to any one of SEQ ID NO: 63 and 570-579, wherein said CRISPR repeat sequence has 100% sequence identity to SEQ ID NO: 64 and said tracrRNA has 100% sequence identity to SEQ ID NO: 65;
k) a RGN polypeptide having 100% sequence identity to SEQ ID NO: 70, wherein said CRISPR repeat sequence has 100% sequence identity to SEQ ID NO: 71 and said tracrRNA has 100% sequence identity to SEQ ID NO: 72;
l) a RGN polypeptide having 100% sequence identity to SEQ ID NO: 76, wherein said CRISPR repeat sequence has 100% sequence identity to SEQ ID NO: 77 and said tracrRNA has 100% sequence identity to SEQ ID NO: 78;
m) a RGN polypeptide having 100% sequence identity to SEQ ID NO: 83, wherein said CRISPR repeat sequence has 100% sequence identity to SEQ ID NO: 84 and said tracrRNA has 100% sequence identity to SEQ ID NO: 85;
n) a RGN polypeptide having 100% sequence identity to SEQ ID NO: 89, wherein said CRISPR repeat sequence has 100% sequence identity to SEQ ID NO: 90 and said tracrRNA has 100% sequence identity to SEQ ID NO: 91;
o) a RGN polypeptide having 100% sequence identity to SEQ ID NO: 96, wherein said CRISPR repeat sequence has 100% sequence identity to SEQ ID NO: 97 and said tracrRNA has 100% sequence identity to SEQ ID NO: 98;
p) a RGN polypeptide having 100% sequence identity to SEQ ID NO: 103, wherein said CRISPR repeat sequence has 100% sequence identity to SEQ ID NO: 104 and said tracrRNA has 100% sequence identity to SEQ ID NO: 105;
q) a RGN polypeptide having 100% sequence identity to SEQ ID NO: 110, wherein said CRISPR repeat sequence has 100% sequence identity to SEQ ID NO: 111 and said tracrRNA has 100% sequence identity to SEQ ID NO: 112;
r) a RGN polypeptide having 100% sequence identity to SEQ ID NO: 117, wherein said CRISPR repeat sequence has 100% sequence identity to SEQ ID NO: 118 and said tracrRNA has 100% sequence identity to SEQ ID NO: 119;
s) a RGN polypeptide having 100% sequence identity to SEQ ID NO: 123, wherein said CRISPR repeat sequence has 100% sequence identity to SEQ ID NO: 124 and said tracrRNA has 100% sequence identity to SEQ ID NO: 125; and
t) a RGN polypeptide having 100% sequence identity to SEQ ID NO: 83, wherein said CRISPR repeat sequence has 100% sequence identity to SEQ ID NO: 84 and said tracrRNA has 100% sequence identity to SEQ ID NO: 78.

57. A nucleic acid molecule comprising a polynucleotide encoding a trans-activating CRISPR RNA (tracrRNA) comprising a nucleotide sequence having at least 90% sequence identity to SEQ ID NOs: 3, 10, 17, 24, 31, 38, 45, 52, 58, 65, 72, 78, 85, 91, 98, 105, 112, 119, or 125;
wherein a guide RNA comprising:
a) said tracrRNA; and
b) a crRNA comprising a spacer sequence and a CRISPR repeat sequence, wherein said tracrRNA hybridizes with said CRISPR repeat sequence of said crRNA;
is capable of hybridizing to a target DNA sequence in a sequence specific manner through the spacer sequence of said crRNA when said guide RNA is bound to an RNA-guided nuclease (RGN) polypeptide, and
wherein said polynucleotide encoding a tracrRNA is operably linked to a promoter heterologous to said polynucleotide.

58. The nucleic acid molecule of embodiment 57, wherein said tracrRNA comprises a nucleotide sequence having at least 95% sequence identity to SEQ ID NOs: 3, 10, 17, 24, 31, 38, 45, 52, 58, 65, 72, 78, 85, 91, 98, 105, 112, 119, or 125.

59. The nucleic acid molecule of embodiment 57, wherein said tracrRNA comprises a nucleotide sequence having 100% sequence identity to SEQ ID NOs: 3, 10, 17, 24, 31, 38, 45, 52, 58, 65, 72, 78, 85, 91, 98, 105, 112, 119, or 125.

60. A vector comprising the nucleic acid molecule of any one of embodiments 57-59.

61. The vector of embodiment 60, wherein said vector further comprises a polynucleotide encoding said crRNA.

62. The vector of embodiment 61, wherein said crRNA comprises a CRISPR repeat sequence selected from the group consisting of:
a) a CRISPR repeat sequence having at least 90% sequence identity to SEQ ID NO: 2, wherein said tracrRNA has at least 90% sequence identity to SEQ ID NO: 3;
b) a CRISPR repeat sequence having at least 90% sequence identity to SEQ ID NO: 9, wherein said tracrRNA has at least 90% sequence identity to SEQ ID NO: 10;
c) a CRISPR repeat sequence having at least 90% sequence identity to SEQ ID NO: 16, wherein said tracrRNA has at least 90% sequence identity to SEQ ID NO: 17;

d) a CRISPR repeat sequence having at least 90% sequence identity to SEQ ID NO: 23, wherein said tracrRNA has at least 90% sequence identity to SEQ ID NO: 24;
e) a CRISPR repeat sequence having at least 90% sequence identity to SEQ ID NO: 30, wherein said tracrRNA has at least 90% sequence identity to SEQ ID NO: 31;
f) a CRISPR repeat sequence having at least 90% sequence identity to SEQ ID NO: 37, wherein said tracrRNA has at least 90% sequence identity to SEQ ID NO: 38;
g) a CRISPR repeat sequence having at least 90% sequence identity to SEQ ID NO: 44, wherein said tracrRNA has at least 90% sequence identity to SEQ ID NO: 45;
h) a CRISPR repeat sequence having at least 90% sequence identity to SEQ ID NO: 51, wherein said tracrRNA has at least 90% sequence identity to SEQ ID NO: 52;
i) a CRISPR repeat sequence having at least 90% sequence identity to SEQ ID NO: 57, wherein said tracrRNA has at least 90% sequence identity to SEQ ID NO: 58;
j) a CRISPR repeat sequence having at least 90% sequence identity to SEQ ID NO: 64, wherein said tracrRNA has at least 90% sequence identity to SEQ ID NO: 65;
k) a CRISPR repeat sequence having at least 90% sequence identity to SEQ ID NO: 71, wherein said tracrRNA has at least 90% sequence identity to SEQ ID NO: 72;
l) a CRISPR repeat sequence having at least 90% sequence identity to SEQ ID NO: 77, wherein said tracrRNA has at least 90% sequence identity to SEQ ID NO: 78;
m) a CRISPR repeat sequence having at least 90% sequence identity to SEQ ID NO: 84, wherein said tracrRNA has at least 90% sequence identity to SEQ ID NO: 85;
n) a CRISPR repeat sequence having at least 90% sequence identity to SEQ ID NO: 90, wherein said tracrRNA has at least 90% sequence identity to SEQ ID NO: 91;
o) a CRISPR repeat sequence having at least 90% sequence identity to SEQ ID NO: 97, wherein said tracrRNA has at least 90% sequence identity to SEQ ID NO: 98;
p) a CRISPR repeat sequence having at least 90% sequence identity to SEQ ID NO: 104, wherein said tracrRNA has at least 90% sequence identity to SEQ ID NO: 105;
q) a CRISPR repeat sequence having at least 90% sequence identity to SEQ ID NO: 111, wherein said tracrRNA has at least 90% sequence identity to SEQ ID NO: 112;
r) a CRISPR repeat sequence having at least 90% sequence identity to SEQ ID NO: 118, wherein said tracrRNA has at least 90% sequence identity to SEQ ID NO: 119; and
s) a CRISPR repeat sequence having at least 90% sequence identity to SEQ ID NO: 124, wherein said tracrRNA has at least 90% sequence identity to SEQ ID NO: 125.

63. The vector of embodiment 61, wherein said crRNA comprises a CRISPR repeat sequence selected from the group consisting of:

a) a CRISPR repeat sequence having at least 95% sequence identity to SEQ ID NO: 2, wherein said tracrRNA has at least 95% sequence identity to SEQ ID NO: 3;
b) a CRISPR repeat sequence having at least 95% sequence identity to SEQ ID NO: 9, wherein said tracrRNA has at least 95% sequence identity to SEQ ID NO: 10;
c) a CRISPR repeat sequence having at least 95% sequence identity to SEQ ID NO: 16, wherein said tracrRNA has at least 95% sequence identity to SEQ ID NO: 17;
d) a CRISPR repeat sequence having at least 95% sequence identity to SEQ ID NO: 23, wherein said tracrRNA has at least 95% sequence identity to SEQ ID NO: 24;
e) a CRISPR repeat sequence having at least 95% sequence identity to SEQ ID NO: 30, wherein said tracrRNA has at least 95% sequence identity to SEQ ID NO: 31;
f) a CRISPR repeat sequence having at least 95% sequence identity to SEQ ID NO: 37, wherein said tracrRNA has at least 95% sequence identity to SEQ ID NO: 38;
g) a CRISPR repeat sequence having at least 95% sequence identity to SEQ ID NO: 44, wherein said tracrRNA has at least 95% sequence identity to SEQ ID NO: 45;
h) a CRISPR repeat sequence having at least 95% sequence identity to SEQ ID NO: 51, wherein said tracrRNA has at least 95% sequence identity to SEQ ID NO: 52;
i) a CRISPR repeat sequence having at least 95% sequence identity to SEQ ID NO: 57, wherein said tracrRNA has at least 95% sequence identity to SEQ ID NO: 58;
j) a CRISPR repeat sequence having at least 95% sequence identity to SEQ ID NO: 64, wherein said tracrRNA has at least 95% sequence identity to SEQ ID NO: 65;
k) a CRISPR repeat sequence having at least 95% sequence identity to SEQ ID NO: 71, wherein said tracrRNA has at least 95% sequence identity to SEQ ID NO: 72;
l) a CRISPR repeat sequence having at least 95% sequence identity to SEQ ID NO: 77, wherein said tracrRNA has at least 95% sequence identity to SEQ ID NO: 78;
m) a CRISPR repeat sequence having at least 95% sequence identity to SEQ ID NO: 84, wherein said tracrRNA has at least 95% sequence identity to SEQ ID NO: 85;
n) a CRISPR repeat sequence having at least 95% sequence identity to SEQ ID NO: 90, wherein said tracrRNA has at least 95% sequence identity to SEQ ID NO: 91;
o) a CRISPR repeat sequence having at least 95% sequence identity to SEQ ID NO: 97, wherein said tracrRNA has at least 95% sequence identity to SEQ ID NO: 98;
p) a CRISPR repeat sequence having at least 95% sequence identity to SEQ ID NO: 104, wherein said tracrRNA has at least 95% sequence identity to SEQ ID NO: 105;

q) a CRISPR repeat sequence having at least 95% sequence identity to SEQ ID NO: 111, wherein said tracrRNA has at least 95% sequence identity to SEQ ID NO: 112;
r) a CRISPR repeat sequence having at least 95% sequence identity to SEQ ID NO: 118, wherein said tracrRNA has at least 95% sequence identity to SEQ ID NO: 119; and
s) a CRISPR repeat sequence having at least 95% sequence identity to SEQ ID NO: 124, wherein said tracrRNA has at least 95% sequence identity to SEQ ID NO: 125.

64. The vector of embodiment 61, wherein said crRNA comprises a CRISPR repeat sequence selected from the group consisting of:
a) a CRISPR repeat sequence having 100% sequence identity to SEQ ID NO: 2, wherein said tracrRNA has 100% sequence identity to SEQ ID NO: 3;
b) a CRISPR repeat sequence having 100% sequence identity to SEQ ID NO: 9, wherein said tracrRNA has 100% sequence identity to SEQ ID NO: 10;
c) a CRISPR repeat sequence having 100% sequence identity to SEQ ID NO: 16, wherein said tracrRNA has 100% sequence identity to SEQ ID NO: 17;
d) a CRISPR repeat sequence having 100% sequence identity to SEQ ID NO: 23, wherein said tracrRNA has 100% sequence identity to SEQ ID NO: 24;
e) a CRISPR repeat sequence having 100% sequence identity to SEQ ID NO: 30, wherein said tracrRNA has 100% sequence identity to SEQ ID NO: 31;
f) a CRISPR repeat sequence having 100% sequence identity to SEQ ID NO: 37, wherein said tracrRNA has 100% sequence identity to SEQ ID NO: 38;
g) a CRISPR repeat sequence having 100% sequence identity to SEQ ID NO: 44, wherein said tracrRNA has 100% sequence identity to SEQ ID NO: 45;
h) a CRISPR repeat sequence having 100% sequence identity to SEQ ID NO: 51, wherein said tracrRNA has 100% sequence identity to SEQ ID NO: 52;
i) a CRISPR repeat sequence having 100% sequence identity to SEQ ID NO: 57, wherein said tracrRNA has 100% sequence identity to SEQ ID NO: 58;
j) a CRISPR repeat sequence having 100% sequence identity to SEQ ID NO: 64, wherein said tracrRNA has 100% sequence identity to SEQ ID NO: 65;
k) a CRISPR repeat sequence having 100% sequence identity to SEQ ID NO: 71, wherein said tracrRNA has 100% sequence identity to SEQ ID NO: 72;
l) a CRISPR repeat sequence having 100% sequence identity to SEQ ID NO: 77, wherein said tracrRNA has 100% sequence identity to SEQ ID NO: 78;
m) a CRISPR repeat sequence having 100% sequence identity to SEQ ID NO: 84, wherein said tracrRNA has 100% sequence identity to SEQ ID NO: 85;
n) a CRISPR repeat sequence having 100% sequence identity to SEQ ID NO: 90, wherein said tracrRNA has 100% sequence identity to SEQ ID NO: 91;
o) a CRISPR repeat sequence having 100% sequence identity to SEQ ID NO: 97, wherein said tracrRNA has 100% sequence identity to SEQ ID NO: 98;
p) a CRISPR repeat sequence having 100% sequence identity to SEQ ID NO: 104, wherein said tracrRNA has 100% sequence identity to SEQ ID NO: 105;
q) a CRISPR repeat sequence having 100% sequence identity to SEQ ID NO: 111, wherein said tracrRNA has 100% sequence identity to SEQ ID NO: 112;
r) a CRISPR repeat sequence having 100% sequence identity to SEQ ID NO: 118, wherein said tracrRNA has 100% sequence identity to SEQ ID NO: 119; and
s) a CRISPR repeat sequence having 100% sequence identity to SEQ ID NO: 124, wherein said tracrRNA has 100% sequence identity to SEQ ID NO: 125.

65. The vector of any one of embodiments 61-64, wherein said polynucleotide encoding said crRNA and said polynucleotide encoding said tracrRNA are operably linked to the same promoter and are encoded as a single guide RNA.

66. The vector of any one of embodiments 61-64, wherein said polynucleotide encoding said crRNA and said polynucleotide encoding said tracrRNA are operably linked to separate promoters.

67. The vector of any one of embodiments 60-66, wherein said vector further comprises a polynucleotide encoding said RGN polypeptide.

68. The vector of embodiment 67, wherein said RGN polypeptide is selected from the group consisting of:
a) a RGN polypeptide having at least 90% sequence identity to SEQ ID NO: 1, wherein said crRNA comprises a CRISPR repeat sequence having at least 90% sequence identity to SEQ ID NO: 2 and said tracrRNA has at least 90% sequence identity to SEQ ID NO: 3;
b) a RGN polypeptide having at least 90% sequence identity to SEQ ID NO: 8, wherein said crRNA comprises a CRISPR repeat sequence having at least 90% sequence identity to SEQ ID NO: 9 and said tracrRNA has at least 90% sequence identity to SEQ ID NO: 10;
c) a RGN polypeptide having at least 90% sequence identity to SEQ ID NO: 15, wherein said crRNA comprises a CRISPR repeat sequence having at least 90% sequence identity to SEQ ID NO: 16 and said tracrRNA has at least 90% sequence identity to SEQ ID NO: 17;
d) a RGN polypeptide having at least 90% sequence identity to SEQ ID NO: 22, wherein said crRNA comprises a CRISPR repeat sequence having at least 90% sequence identity to SEQ ID NO: 23 and said tracrRNA has at least 90% sequence identity to SEQ ID NO: 24;
e) a RGN polypeptide having at least 90% sequence identity to SEQ ID NO: 29, wherein said crRNA comprises a CRISPR repeat sequence having at least 90% sequence identity to SEQ ID NO: 30 and said tracrRNA has at least 90% sequence identity to SEQ ID NO: 31;
f) a RGN polypeptide having at least 90% sequence identity to SEQ ID NO: 36, wherein said crRNA comprises a CRISPR repeat sequence having at least 90% sequence identity to SEQ ID NO: 37 and said tracrRNA has at least 90% sequence identity to SEQ ID NO: 38;
g) a RGN polypeptide having at least 90% sequence identity to SEQ ID NO: 43, wherein said crRNA comprises a CRISPR repeat sequence having at least 90% sequence identity to SEQ ID NO: 44 and said tracrRNA has at least 90% sequence identity to SEQ ID NO: 45;
h) a RGN polypeptide having at least 90% sequence identity to SEQ ID NO: 50, wherein said crRNA comprises a CRISPR repeat sequence having at least 90% sequence identity to SEQ ID NO: 51 and said tracrRNA has at least 90% sequence identity to SEQ ID NO: 52;

i) a RGN polypeptide having at least 90% sequence identity to SEQ ID NO: 56, wherein said crRNA comprises a CRISPR repeat sequence having at least 90% sequence identity to SEQ ID NO: 57 and said tracrRNA has at least 90% sequence identity to SEQ ID NO: 58;

j) a RGN polypeptide having at least 90% sequence identity to any one of SEQ ID NO: 63 and 570-579, wherein said crRNA comprises a CRISPR repeat sequence having at least 90% sequence identity to SEQ ID NO: 64 and said tracrRNA has at least 90% sequence identity to SEQ ID NO: 65;

k) a RGN polypeptide having at least 90% sequence identity to SEQ ID NO: 70, wherein said crRNA comprises a CRISPR repeat sequence having at least 90% sequence identity to SEQ ID NO: 71 and said tracrRNA has at least 90% sequence identity to SEQ ID NO: 72;

l) a RGN polypeptide having at least 90% sequence identity to SEQ ID NO: 76, wherein said crRNA comprises a CRISPR repeat sequence having at least 90% sequence identity to SEQ ID NO: 77 and said tracrRNA has at least 90% sequence identity to SEQ ID NO: 78;

m) a RGN polypeptide having at least 90% sequence identity to SEQ ID NO: 83, wherein said crRNA comprises a CRISPR repeat sequence having at least 90% sequence identity to SEQ ID NO: 84 and said tracrRNA has at least 90% sequence identity to SEQ ID NO: 85;

n) a RGN polypeptide having at least 90% sequence identity to SEQ ID NO: 89, wherein said crRNA comprises a CRISPR repeat sequence having at least 90% sequence identity to SEQ ID NO: 90 and said tracrRNA has at least 90% sequence identity to SEQ ID NO: 91;

o) a RGN polypeptide having at least 90% sequence identity to SEQ ID NO: 96, wherein said crRNA comprises a CRISPR repeat sequence having at least 90% sequence identity to SEQ ID NO: 97 and said tracrRNA has at least 90% sequence identity to SEQ ID NO: 98;

p) a RGN polypeptide having at least 90% sequence identity to SEQ ID NO: 103, wherein said crRNA comprises a CRISPR repeat sequence having at least 90% sequence identity to SEQ ID NO: 104 and said tracrRNA has at least 90% sequence identity to SEQ ID NO: 105;

q) a RGN polypeptide having at least 90% sequence identity to SEQ ID NO: 110, wherein said crRNA comprises a CRISPR repeat sequence having at least 90% sequence identity to SEQ ID NO: 111 and said tracrRNA has at least 90% sequence identity to SEQ ID NO: 112;

r) a RGN polypeptide having at least 90% sequence identity to SEQ ID NO: 117, wherein said crRNA comprises a CRISPR repeat sequence having at least 90% sequence identity to SEQ ID NO: 118 and said tracrRNA has at least 90% sequence identity to SEQ ID NO: 119;

s) a RGN polypeptide having at least 90% sequence identity to SEQ ID NO: 123, wherein said crRNA comprises a CRISPR repeat sequence having at least 90% sequence identity to SEQ ID NO: 124 and said tracrRNA has at least 90% sequence identity to SEQ ID NO: 125; and t) a RGN polypeptide having at least 90% sequence identity to SEQ ID NO: 83, wherein said crRNA comprises a CRISPR repeat sequence having at least 90% sequence identity to SEQ ID NO: 84 and said tracrRNA has at least 90% sequence identity to SEQ ID NO: 78.

69. The vector of embodiment 67, wherein said RGN polypeptide is selected from the group consisting of:

a) a RGN polypeptide having at least 95% sequence identity to SEQ ID NO: 1, wherein said crRNA comprises a CRISPR repeat sequence having at least 95% sequence identity to SEQ ID NO: 2 and said tracrRNA has at least 95% sequence identity to SEQ ID NO: 3;

b) a RGN polypeptide having at least 95% sequence identity to SEQ ID NO: 8, wherein said crRNA comprises a CRISPR repeat sequence having at least 95% sequence identity to SEQ ID NO: 9 and said tracrRNA has at least 95% sequence identity to SEQ ID NO: 10;

c) a RGN polypeptide having at least 95% sequence identity to SEQ ID NO: 15, wherein said crRNA comprises a CRISPR repeat sequence having at least 95% sequence identity to SEQ ID NO: 16 and said tracrRNA has at least 95% sequence identity to SEQ ID NO: 17;

d) a RGN polypeptide having at least 95% sequence identity to SEQ ID NO: 22, wherein said crRNA comprises a CRISPR repeat sequence having at least 95% sequence identity to SEQ ID NO: 23 and said tracrRNA has at least 95% sequence identity to SEQ ID NO: 24;

e) a RGN polypeptide having at least 95% sequence identity to SEQ ID NO: 29, wherein said crRNA comprises a CRISPR repeat sequence having at least 95% sequence identity to SEQ ID NO: 30 and said tracrRNA has at least 95% sequence identity to SEQ ID NO: 31;

f) a RGN polypeptide having at least 95% sequence identity to SEQ ID NO: 36, wherein said crRNA comprises a CRISPR repeat sequence having at least 95% sequence identity to SEQ ID NO: 37 and said tracrRNA has at least 95% sequence identity to SEQ ID NO: 38;

g) a RGN polypeptide having at least 95% sequence identity to SEQ ID NO: 43, wherein said crRNA comprises a CRISPR repeat sequence having at least 95% sequence identity to SEQ ID NO: 44 and said tracrRNA has at least 95% sequence identity to SEQ ID NO: 45;

h) a RGN polypeptide having at least 95% sequence identity to SEQ ID NO: 50, wherein said crRNA comprises a CRISPR repeat sequence having at least 95% sequence identity to SEQ ID NO: 51 and said tracrRNA has at least 95% sequence identity to SEQ ID NO: 52;

i) a RGN polypeptide having at least 95% sequence identity to SEQ ID NO: 56, wherein said crRNA comprises a CRISPR repeat sequence having at least 95% sequence identity to SEQ ID NO: 57 and said tracrRNA has at least 95% sequence identity to SEQ ID NO: 58;

j) a RGN polypeptide having at least 95% sequence identity to any one of SEQ ID NO: 63 and 570-579, wherein said crRNA comprises a CRISPR repeat sequence having at least 95% sequence identity to SEQ ID NO: 64 and said tracrRNA has at least 95% sequence identity to SEQ ID NO: 65;

k) a RGN polypeptide having at least 95% sequence identity to SEQ ID NO: 70, wherein said crRNA comprises a CRISPR repeat sequence having at least 95% sequence identity to SEQ ID NO: 71 and said tracrRNA has at least 95% sequence identity to SEQ ID NO: 72;

l) a RGN polypeptide having at least 95% sequence identity to SEQ ID NO: 76, wherein said crRNA comprises a CRISPR repeat sequence having at least 95% sequence identity to SEQ ID NO: 77 and said tracrRNA has at least 95% sequence identity to SEQ ID NO: 78;

m) a RGN polypeptide having at least 95% sequence identity to SEQ ID NO: 83, wherein said crRNA comprises a CRISPR repeat sequence having at least 95% sequence identity to SEQ ID NO: 84 and said tracrRNA has at least 95% sequence identity to SEQ ID NO: 85;

n) a RGN polypeptide having at least 95% sequence identity to SEQ ID NO: 89, wherein said crRNA comprises a CRISPR repeat sequence having at least 95% sequence identity to SEQ ID NO: 90 and said tracrRNA has at least 95% sequence identity to SEQ ID NO: 91;

o) a RGN polypeptide having at least 95% sequence identity to SEQ ID NO: 96, wherein said crRNA comprises a CRISPR repeat sequence having at least 95% sequence identity to SEQ ID NO: 97 and said tracrRNA has at least 95% sequence identity to SEQ ID NO: 98;

p) a RGN polypeptide having at least 95% sequence identity to SEQ ID NO: 103, wherein said crRNA comprises a CRISPR repeat sequence having at least 95% sequence identity to SEQ ID NO: 104 and said tracrRNA has at least 95% sequence identity to SEQ ID NO: 105;

q) a RGN polypeptide having at least 95% sequence identity to SEQ ID NO: 110, wherein said crRNA comprises a CRISPR repeat sequence having at least 95% sequence identity to SEQ ID NO: 111 and said tracrRNA has at least 95% sequence identity to SEQ ID NO: 112;

r) a RGN polypeptide having at least 95% sequence identity to SEQ ID NO: 117, wherein said crRNA comprises a CRISPR repeat sequence having at least 95% sequence identity to SEQ ID NO: 118 and said tracrRNA has at least 95% sequence identity to SEQ ID NO: 119;

s) a RGN polypeptide having at least 95% sequence identity to SEQ ID NO: 123, wherein said crRNA comprises a CRISPR repeat sequence having at least 95% sequence identity to SEQ ID NO: 124 and said tracrRNA has at least 95% sequence identity to SEQ ID NO: 125; and t) a RGN polypeptide having at least 95% sequence identity to SEQ ID NO: 83, wherein said crRNA comprises a CRISPR repeat sequence having at least 95% sequence identity to SEQ ID NO: 84 and said tracrRNA has at least 95% sequence identity to SEQ ID NO: 78.

70. The vector of embodiment 67, wherein said RGN polypeptide is selected from the group consisting of:

a) a RGN polypeptide having 100% sequence identity to SEQ ID NO: 1, wherein said crRNA comprises a CRISPR repeat sequence having 100% sequence identity to SEQ ID NO: 2 and said tracrRNA has 100% sequence identity to SEQ ID NO: 3;

b) a RGN polypeptide having 100% sequence identity to SEQ ID NO: 8, wherein said crRNA comprises a CRISPR repeat sequence having 100% sequence identity to SEQ ID NO: 9 and said tracrRNA has 100% sequence identity to SEQ ID NO: 10;

c) a RGN polypeptide having 100% sequence identity to SEQ ID NO: 15, wherein said crRNA comprises a CRISPR repeat sequence having 100% sequence identity to SEQ ID NO: 16 and said tracrRNA has 100% sequence identity to SEQ ID NO: 17;

d) a RGN polypeptide having 100% sequence identity to SEQ ID NO: 22, wherein said crRNA comprises a CRISPR repeat sequence having 100% sequence identity to SEQ ID NO: 23 and said tracrRNA has 100% sequence identity to SEQ ID NO: 24;

e) a RGN polypeptide having 100% sequence identity to SEQ ID NO: 29, wherein said crRNA comprises a CRISPR repeat sequence having 100% sequence identity to SEQ ID NO: 30 and said tracrRNA has 100% sequence identity to SEQ ID NO: 31;

f) a RGN polypeptide having 100% sequence identity to SEQ ID NO: 36, wherein said crRNA comprises a CRISPR repeat sequence having 100% sequence identity to SEQ ID NO: 37 and said tracrRNA has 100% sequence identity to SEQ ID NO: 38;

g) a RGN polypeptide having 100% sequence identity to SEQ ID NO: 43, wherein said crRNA comprises a CRISPR repeat sequence having 100% sequence identity to SEQ ID NO: 44 and said tracrRNA has 100% sequence identity to SEQ ID NO: 45;

h) a RGN polypeptide having 100% sequence identity to SEQ ID NO: 50, wherein said crRNA comprises a CRISPR repeat sequence having 100% sequence identity to SEQ ID NO: 51 and said tracrRNA has 100% sequence identity to SEQ ID NO: 52;

i) a RGN polypeptide having 100% sequence identity to SEQ ID NO: 56, wherein said crRNA comprises a CRISPR repeat sequence having 100% sequence identity to SEQ ID NO: 57 and said tracrRNA has 100% sequence identity to SEQ ID NO: 58;

j) a RGN polypeptide having 100% sequence identity to any one of SEQ ID NO: 63 and 570-579, wherein said crRNA comprises a CRISPR repeat sequence having 100% sequence identity to SEQ ID NO: 64 and said tracrRNA has 100% sequence identity to SEQ ID NO: 65;

k) a RGN polypeptide having 100% sequence identity to SEQ ID NO: 70, wherein said crRNA comprises a CRISPR repeat sequence having 100% sequence identity to SEQ ID NO: 71 and said tracrRNA has 100% sequence identity to SEQ ID NO: 72;

l) a RGN polypeptide having 100% sequence identity to SEQ ID NO: 76, wherein said crRNA comprises a CRISPR repeat sequence having 100% sequence identity to SEQ ID NO: 77 and said tracrRNA has 100% sequence identity to SEQ ID NO: 78;

m) a RGN polypeptide having 100% sequence identity to SEQ ID NO: 83, wherein said crRNA comprises a CRISPR repeat sequence having 100% sequence identity to SEQ ID NO: 84 and said tracrRNA has 100% sequence identity to SEQ ID NO: 85;

n) a RGN polypeptide having 100% sequence identity to SEQ ID NO: 89, wherein said crRNA comprises a CRISPR repeat sequence having 100% sequence identity to SEQ ID NO: 90 and said tracrRNA has 100% sequence identity to SEQ ID NO: 91;

o) a RGN polypeptide having 100% sequence identity to SEQ ID NO: 96, wherein said crRNA comprises a CRISPR repeat sequence having 100% sequence identity to SEQ ID NO: 97 and said tracrRNA has 100% sequence identity to SEQ ID NO: 98;
p) a RGN polypeptide having 100% sequence identity to SEQ ID NO: 103, wherein said crRNA comprises a CRISPR repeat sequence having 100% sequence identity to SEQ ID NO: 104 and said tracrRNA has 100% sequence identity to SEQ ID NO: 105;
q) a RGN polypeptide having 100% sequence identity to SEQ ID NO: 110, wherein said crRNA comprises a CRISPR repeat sequence having 100% sequence identity to SEQ ID NO: 111 and said tracrRNA has 100% sequence identity to SEQ ID NO: 112;
r) a RGN polypeptide having 100% sequence identity to SEQ ID NO: 117, wherein said crRNA comprises a CRISPR repeat sequence having 100% sequence identity to SEQ ID NO: 118 and said tracrRNA has 100% sequence identity to SEQ ID NO: 119;
s) a RGN polypeptide having 100% sequence identity to SEQ ID NO: 123, wherein said crRNA comprises a CRISPR repeat sequence having 100% sequence identity to SEQ ID NO: 124 and said tracrRNA has 100% sequence identity to SEQ ID NO: 125; and
t) a RGN polypeptide having 100% sequence identity to SEQ ID NO: 83, wherein said crRNA comprises a CRISPR repeat sequence having 100% sequence identity to SEQ ID NO: 84 and said tracrRNA has 100% sequence identity to SEQ ID NO: 78.

71. A system for binding a target DNA sequence of a DNA molecule, said system comprising:
 a) one or more guide RNAs capable of hybridizing to said target DNA sequence or one or more polynucleotides comprising one or more nucleotide sequences encoding the one or more guide RNAs (gRNAs); and
 b) an RNA-guided nuclease (RGN) polypeptide comprising an amino acid sequence having at least 90% sequence identity to any one of SEQ ID NOs: 1, 8, 15, 22, 29, 36, 43, 50, 56, 63, 70, 76, 83, 89, 96, 103, 110, 117, 123, and 570-579 or a polynucleotide comprising a nucleotide sequence encoding the RGN polypeptide;
wherein at least one of said nucleotide sequences encoding the one or more guide RNAs and said nucleotide sequence encoding the RGN polypeptide is operably linked to a promoter heterologous to said nucleotide sequence;
 wherein the one or more guide RNAs are capable of hybridizing to the target DNA sequence, and
 wherein the one or more guide RNAs are capable of forming a complex with the RGN polypeptide in order to direct said RGN polypeptide to bind to said target DNA sequence of the DNA molecule.

72. A system for binding a target DNA sequence of a DNA molecule, said system comprising:
 a) one or more guide RNAs capable of hybridizing to said target DNA sequence or one or more polynucleotides comprising one or more nucleotide sequences encoding the one or more guide RNAs (gRNAs); and
 b) an RNA-guided nuclease (RGN) polypeptide comprising an amino acid sequence having at least 90% sequence identity to any one of SEQ ID NOs: 1, 8, 15, 22, 29, 36, 43, 50, 56, 63, 70, 76, 83, 89, 96, 103, 110, 117, 123, and 570-579;
wherein the one or more guide RNAs are capable of hybridizing to the target DNA sequence, and
 wherein the one or more guide RNAs are capable of forming a complex with the RGN polypeptide in order to direct said RGN polypeptide to bind to said target DNA sequence of the DNA molecule.

73. The system of embodiment 71 or 72, wherein at least one of said nucleotides sequences encoding the one or more guide RNAs is operably linked to a promoter heterologous to said nucleotide sequence.

74. The system of any one of embodiments 71-73, wherein said RGN polypeptide comprises an amino acid sequence having at least 95% sequence identity to any one of SEQ ID NOs: 1, 8, 15, 22, 29, 36, 43, 50, 56, 63, 70, 76, 83, 89, 96, 103, 110, 117, 123, and 570-579. 75. The system of any one of embodiments 71-73, wherein said RGN polypeptide comprises an amino acid sequence having 100% sequence identity to any one of SEQ ID NOs: 1, 8, 15, 22, 29, 36, 43, 50, 56, 63, 70, 76, 83, 89, 96, 103, 110, 117, 123, and 570-579.

76. The system of any one of embodiments 71-73, wherein said RGN polypeptide has at least 90% sequence identity to SEQ ID NO: 63 and has an isoleucine at an amino acid position corresponding to 305, a valine at an amino acid position corresponding to 328, a leucine at an amino acid position corresponding to 366, a threonine at an amino acid position corresponding to 368, and a valine at an amino acid position corresponding to 405 of SEQ ID NO: 63.

77. The system of any one of embodiments 71-76, wherein said RGN polypeptide and said one or more guide RNAs are not found complexed to one another in nature.

78. The system of any one of embodiments 71-77, wherein said target DNA sequence is a eukaryotic target DNA sequence.

79. The system of any one of embodiments 71-78, wherein said gRNA is a single guide RNA (sgRNA).

80. The system of any one of embodiments 71-78, wherein said gRNA is a dual-guide RNA.

81. The system of any one of embodiments 71-80, wherein said gRNA is selected from the group consisting of:
a) a gRNA comprising a CRISPR repeat sequence having at least 90% sequence identity to SEQ ID NO: 2 and a tracrRNA having at least 90% sequence identity to SEQ ID NO: 3, wherein said RGN polypeptide comprises an amino acid sequence having at least 90% sequence identity to SEQ ID NO: 1;
b) a gRNA comprising a CRISPR repeat sequence having at least 90% sequence identity to SEQ ID NO: 9 and a tracrRNA having at least 90% sequence identity to SEQ ID NO: 10, wherein said RGN polypeptide comprises an amino acid sequence having at least 90% sequence identity to SEQ ID NO: 8;
c) a gRNA comprising a CRISPR repeat sequence having at least 90% sequence identity to SEQ ID NO: 16 and a tracrRNA having at least 90% sequence identity to SEQ ID NO: 17, wherein said RGN polypeptide comprises an amino acid sequence having at least 90% sequence identity to SEQ ID NO: 15;
d) a gRNA comprising a CRISPR repeat sequence having at least 90% sequence identity to SEQ ID NO: 23 and a tracrRNA having at least 90% sequence identity to SEQ ID NO: 24, wherein said RGN polypeptide comprises an amino acid sequence having at least 90% sequence identity to SEQ ID NO: 22;

e) a gRNA comprising a CRISPR repeat sequence having at least 90% sequence identity to SEQ ID NO: 30 and a tracrRNA having at least 90% sequence identity to SEQ ID NO: 31, wherein said RGN polypeptide comprises an amino acid sequence having at least 90% sequence identity to SEQ ID NO: 29;

f) a gRNA comprising a CRISPR repeat sequence having at least 90% sequence identity to SEQ ID NO: 37 and a tracrRNA having at least 90% sequence identity to SEQ ID NO: 38, wherein said RGN polypeptide comprises an amino acid sequence having at least 90% sequence identity to SEQ ID NO: 36;

g) a gRNA comprising a CRISPR repeat sequence having at least 90% sequence identity to SEQ ID NO: 44 and a tracrRNA having at least 90% sequence identity to SEQ ID NO: 45, wherein said RGN polypeptide comprises an amino acid sequence having at least 90% sequence identity to SEQ ID NO: 43;

h) a gRNA comprising a CRISPR repeat sequence having at least 90% sequence identity to SEQ ID NO: 51 and a tracrRNA having at least 90% sequence identity to SEQ ID NO: 52, wherein said RGN polypeptide comprises an amino acid sequence having at least 90% sequence identity to SEQ ID NO: 50;

i) a gRNA comprising a CRISPR repeat sequence having at least 90% sequence identity to SEQ ID NO: 57 and a tracrRNA having at least 90% sequence identity to SEQ ID NO: 58, wherein said RGN polypeptide comprises an amino acid sequence having at least 90% sequence identity to SEQ ID NO: 56;

j) a gRNA comprising a CRISPR repeat sequence having at least 90% sequence identity to SEQ ID NO: 64 and a tracrRNA having at least 90% sequence identity to SEQ ID NO: 65, wherein said RGN polypeptide comprises an amino acid sequence having at least 90% sequence identity to any one of SEQ ID NOs: 63 and 570-579;

k) a gRNA comprising a CRISPR repeat sequence having at least 90% sequence identity to SEQ ID NO: 71 and a tracrRNA having at least 90% sequence identity to SEQ ID NO: 72, wherein said RGN polypeptide comprises an amino acid sequence having at least 90% sequence identity to SEQ ID NO: 70;

l) a gRNA comprising a CRISPR repeat sequence having at least 90% sequence identity to SEQ ID NO: 77 and a tracrRNA having at least 90% sequence identity to SEQ ID NO: 78, wherein said RGN polypeptide comprises an amino acid sequence having at least 90% sequence identity to SEQ ID NO: 76;

m) a gRNA comprising a CRISPR repeat sequence having at least 90% sequence identity to SEQ ID NO: 84 and a tracrRNA having at least 90% sequence identity to SEQ ID NO: 85, wherein said RGN polypeptide comprises an amino acid sequence having at least 90% sequence identity to SEQ ID NO: 83;

n) a gRNA comprising a CRISPR repeat sequence having at least 90% sequence identity to SEQ ID NO: 90 and a tracrRNA having at least 90% sequence identity to SEQ ID NO: 91, wherein said RGN polypeptide comprises an amino acid sequence having at least 90% sequence identity to SEQ ID NO: 89;

o) a gRNA comprising a CRISPR repeat sequence having at least 90% sequence identity to SEQ ID NO: 97 and a tracrRNA having at least 90% sequence identity to SEQ ID NO: 98, wherein said RGN polypeptide comprises an amino acid sequence having at least 90% sequence identity to SEQ ID NO: 96;

p) a gRNA comprising a CRISPR repeat sequence having at least 90% sequence identity to SEQ ID NO: 104 and a tracrRNA having at least 90% sequence identity to SEQ ID NO: 105, wherein said RGN polypeptide comprises an amino acid sequence having at least 90% sequence identity to SEQ ID NO: 103;

q) a gRNA comprising a CRISPR repeat sequence having at least 90% sequence identity to SEQ ID NO: 111 and a tracrRNA having at least 90% sequence identity to SEQ ID NO: 112, wherein said RGN polypeptide comprises an amino acid sequence having at least 90% sequence identity to SEQ ID NO: 110;

r) a gRNA comprising a CRISPR repeat sequence having at least 90% sequence identity to SEQ ID NO: 118 and a tracrRNA having at least 90% sequence identity to SEQ ID NO: 119, wherein said RGN polypeptide comprises an amino acid sequence having at least 90% sequence identity to SEQ ID NO: 117;

s) a gRNA comprising a CRISPR repeat sequence having at least 90% sequence identity to SEQ ID NO: 124 and a tracrRNA having at least 90% sequence identity to SEQ ID NO: 125, wherein said RGN polypeptide comprises an amino acid sequence having at least 90% sequence identity to SEQ ID NO: 123; and t) a gRNA comprising a CRISPR repeat sequence having at least 90% sequence identity to SEQ ID NO: 84 and a tracrRNA having at least 90% sequence identity to SEQ ID NO: 78, wherein said RGN polypeptide comprises an amino acid sequence having at least 90% sequence identity to SEQ ID NO: 83.

82. The system of any one of embodiments 71-80, wherein said gRNA is selected from the group consisting of:

a) a gRNA comprising a CRISPR repeat sequence having at least 95% sequence identity to SEQ ID NO: 2 and a tracrRNA having at least 95% sequence identity to SEQ ID NO: 3, wherein said RGN polypeptide comprises an amino acid sequence having at least 95% sequence identity to SEQ ID NO: 1;

b) a gRNA comprising a CRISPR repeat sequence having at least 95% sequence identity to SEQ ID NO: 9 and a tracrRNA having at least 95% sequence identity to SEQ ID NO: 10, wherein said RGN polypeptide comprises an amino acid sequence having at least 95% sequence identity to SEQ ID NO: 8;

c) a gRNA comprising a CRISPR repeat sequence having at least 95% sequence identity to SEQ ID NO: 16 and a tracrRNA having at least 95% sequence identity to SEQ ID NO: 17, wherein said RGN polypeptide comprises an amino acid sequence having at least 95% sequence identity to SEQ ID NO: 15;

d) a gRNA comprising a CRISPR repeat sequence having at least 95% sequence identity to SEQ ID NO: 23 and a tracrRNA having at least 95% sequence identity to SEQ ID NO: 24, wherein said RGN polypeptide comprises an amino acid sequence having at least 95% sequence identity to SEQ ID NO: 22;

e) a gRNA comprising a CRISPR repeat sequence having at least 95% sequence identity to SEQ ID NO: 30 and a tracrRNA having at least 95% sequence identity to SEQ ID NO: 31, wherein said RGN polypeptide comprises an amino acid sequence having at least 95% sequence identity to SEQ ID NO: 29;

f) a gRNA comprising a CRISPR repeat sequence having at least 95% sequence identity to SEQ ID NO: 37 and a tracrRNA having at least 95% sequence identity to SEQ ID NO: 38, wherein said RGN polypeptide comprises an amino acid sequence having at least 95% sequence identity to SEQ ID NO: 36;
g) a gRNA comprising a CRISPR repeat sequence having at least 95% sequence identity to SEQ ID NO: 44 and a tracrRNA having at least 95% sequence identity to SEQ ID NO: 45, wherein said RGN polypeptide comprises an amino acid sequence having at least 95% sequence identity to SEQ ID NO: 43;
h) a gRNA comprising a CRISPR repeat sequence having at least 95% sequence identity to SEQ ID NO: 51 and a tracrRNA having at least 95% sequence identity to SEQ ID NO: 52, wherein said RGN polypeptide comprises an amino acid sequence having at least 95% sequence identity to SEQ ID NO: 50;
i) a gRNA comprising a CRISPR repeat sequence having at least 95% sequence identity to SEQ ID NO: 57 and a tracrRNA having at least 95% sequence identity to SEQ ID NO: 58, wherein said RGN polypeptide comprises an amino acid sequence having at least 95% sequence identity to SEQ ID NO: 56;
j) a gRNA comprising a CRISPR repeat sequence having at least 95% sequence identity to SEQ ID NO: 64 and a tracrRNA having at least 95% sequence identity to SEQ ID NO: 65, wherein said RGN polypeptide comprises an amino acid sequence having at least 95% sequence identity to any one of SEQ ID NOs: 63 and 570-579;
k) a gRNA comprising a CRISPR repeat sequence having at least 95% sequence identity to SEQ ID NO: 71 and a tracrRNA having at least 95% sequence identity to SEQ ID NO: 72, wherein said RGN polypeptide comprises an amino acid sequence having at least 95% sequence identity to SEQ ID NO: 70;
l) a gRNA comprising a CRISPR repeat sequence having at least 95% sequence identity to SEQ ID NO: 77 and a tracrRNA having at least 95% sequence identity to SEQ ID NO: 78, wherein said RGN polypeptide comprises an amino acid sequence having at least 95% sequence identity to SEQ ID NO: 76;
m) a gRNA comprising a CRISPR repeat sequence having at least 95% sequence identity to SEQ ID NO: 84 and a tracrRNA having at least 95% sequence identity to SEQ ID NO: 85, wherein said RGN polypeptide comprises an amino acid sequence having at least 95% sequence identity to SEQ ID NO: 83;
n) a gRNA comprising a CRISPR repeat sequence having at least 95% sequence identity to SEQ ID NO: 90 and a tracrRNA having at least 95% sequence identity to SEQ ID NO: 91, wherein said RGN polypeptide comprises an amino acid sequence having at least 95% sequence identity to SEQ ID NO: 89;
o) a gRNA comprising a CRISPR repeat sequence having at least 95% sequence identity to SEQ ID NO: 97 and a tracrRNA having at least 95% sequence identity to SEQ ID NO: 98, wherein said RGN polypeptide comprises an amino acid sequence having at least 95% sequence identity to SEQ ID NO: 96;
p) a gRNA comprising a CRISPR repeat sequence having at least 95% sequence identity to SEQ ID NO: 104 and a tracrRNA having at least 95% sequence identity to SEQ ID NO: 105, wherein said RGN polypeptide comprises an amino acid sequence having at least 95% sequence identity to SEQ ID NO: 103;
q) a gRNA comprising a CRISPR repeat sequence having at least 95% sequence identity to SEQ ID NO: 111 and a tracrRNA having at least 95% sequence identity to SEQ ID NO: 112, wherein said RGN polypeptide comprises an amino acid sequence having at least 95% sequence identity to SEQ ID NO: 110;
r) a gRNA comprising a CRISPR repeat sequence having at least 95% sequence identity to SEQ ID NO: 118 and a tracrRNA having at least 95% sequence identity to SEQ ID NO: 119, wherein said RGN polypeptide comprises an amino acid sequence having at least 95% sequence identity to SEQ ID NO: 117;
s) a gRNA comprising a CRISPR repeat sequence having at least 95% sequence identity to SEQ ID NO: 124 and a tracrRNA having at least 95% sequence identity to SEQ ID NO: 125, wherein said RGN polypeptide comprises an amino acid sequence having at least 95% sequence identity to SEQ ID NO: 123; and
t) a gRNA comprising a CRISPR repeat sequence having at least 95% sequence identity to SEQ ID NO: 84 and a tracrRNA having at least 95% sequence identity to SEQ ID NO: 78, wherein said RGN polypeptide comprises an amino acid sequence having at least 95% sequence identity to SEQ ID NO: 83.

83. The system of any one of embodiments 71-80, wherein said gRNA is selected from the group consisting of:
a) a gRNA comprising a CRISPR repeat sequence having 100% sequence identity to SEQ ID NO: 2 and a tracrRNA having 100% sequence identity to SEQ ID NO: 3, wherein said RGN polypeptide comprises an amino acid sequence having 100% sequence identity to SEQ ID NO: 1;
b) a gRNA comprising a CRISPR repeat sequence having 100% sequence identity to SEQ ID NO: 9 and a tracrRNA having 100% sequence identity to SEQ ID NO: 10, wherein said RGN polypeptide comprises an amino acid sequence having 100% sequence identity to SEQ ID NO: 8;
c) a gRNA comprising a CRISPR repeat sequence having 100% sequence identity to SEQ ID NO: 16 and a tracrRNA having 100% sequence identity to SEQ ID NO: 17, wherein said RGN polypeptide comprises an amino acid sequence having 100% sequence identity to SEQ ID NO: 15;
d) a gRNA comprising a CRISPR repeat sequence having 100% sequence identity to SEQ ID NO: 23 and a tracrRNA having 100% sequence identity to SEQ ID NO: 24, wherein said RGN polypeptide comprises an amino acid sequence having 100% sequence identity to SEQ ID NO: 22;
e) a gRNA comprising a CRISPR repeat sequence having 100% sequence identity to SEQ ID NO: 30 and a tracrRNA having 100% sequence identity to SEQ ID NO: 31, wherein said RGN polypeptide comprises an amino acid sequence having 100% sequence identity to SEQ ID NO: 29;
f) a gRNA comprising a CRISPR repeat sequence having 100% sequence identity to SEQ ID NO: 37 and a tracrRNA having 100% sequence identity to SEQ ID NO: 38, wherein said RGN polypeptide comprises an amino acid sequence having 100% sequence identity to SEQ ID NO: 36;
g) a gRNA comprising a CRISPR repeat sequence having 100% sequence identity to SEQ ID NO: 44 and a tracrRNA having 100% sequence identity to SEQ ID NO: 45, wherein said RGN polypeptide comprises an amino acid sequence having 100% sequence identity to SEQ ID NO: 43;
h) a gRNA comprising a CRISPR repeat sequence having 100% sequence identity to SEQ ID NO: 51 and a tracrRNA having 100% sequence identity to SEQ ID NO: 52, wherein said RGN polypeptide comprises an amino acid sequence having 100% sequence identity to SEQ ID NO: 50;

i) a gRNA comprising a CRISPR repeat sequence having 100% sequence identity to SEQ ID NO: 57 and a tracrRNA having 100% sequence identity to SEQ ID NO: 58, wherein said RGN polypeptide comprises an amino acid sequence having 100% sequence identity to SEQ ID NO: 56;

j) a gRNA comprising a CRISPR repeat sequence having 100% sequence identity to SEQ ID NO: 64 and a tracrRNA having 100% sequence identity to SEQ ID NO: 65, wherein said RGN polypeptide comprises an amino acid sequence having 100% sequence identity to any one of SEQ ID NOs: 63 and 570-579;

k) a gRNA comprising a CRISPR repeat sequence having 100% sequence identity to SEQ ID NO: 71 and a tracrRNA having 100% sequence identity to SEQ ID NO: 72, wherein said RGN polypeptide comprises an amino acid sequence having 100% sequence identity to SEQ ID NO: 70;

l) a gRNA comprising a CRISPR repeat sequence having 100% sequence identity to SEQ ID NO: 77 and a tracrRNA having 100% sequence identity to SEQ ID NO: 78, wherein said RGN polypeptide comprises an amino acid sequence having 100% sequence identity to SEQ ID NO: 76;

m) a gRNA comprising a CRISPR repeat sequence having 100% sequence identity to SEQ ID NO: 84 and a tracrRNA having 100% sequence identity to SEQ ID NO: 85, wherein said RGN polypeptide comprises an amino acid sequence having 100% sequence identity to SEQ ID NO: 83;

n) a gRNA comprising a CRISPR repeat sequence having 100% sequence identity to SEQ ID NO: 90 and a tracrRNA having 100% sequence identity to SEQ ID NO: 91, wherein said RGN polypeptide comprises an amino acid sequence having 100% sequence identity to SEQ ID NO: 89;

o) a gRNA comprising a CRISPR repeat sequence having 100% sequence identity to SEQ ID NO: 97 and a tracrRNA having 100% sequence identity to SEQ ID NO: 98, wherein said RGN polypeptide comprises an amino acid sequence having 100% sequence identity to SEQ ID NO: 96;

p) a gRNA comprising a CRISPR repeat sequence having 100% sequence identity to SEQ ID NO: 104 and a tracrRNA having 100% sequence identity to SEQ ID NO: 105, wherein said RGN polypeptide comprises an amino acid sequence having 100% sequence identity to SEQ ID NO: 103;

q) a gRNA comprising a CRISPR repeat sequence having 100% sequence identity to SEQ ID NO: 111 and a tracrRNA having 100% sequence identity to SEQ ID NO: 112, wherein said RGN polypeptide comprises an amino acid sequence having 100% sequence identity to SEQ ID NO: 110;

r) a gRNA comprising a CRISPR repeat sequence having 100% sequence identity to SEQ ID NO: 118 and a tracrRNA having 100% sequence identity to SEQ ID NO: 119, wherein said RGN polypeptide comprises an amino acid sequence having 100% sequence identity to SEQ ID NO: 117;

s) a gRNA comprising a CRISPR repeat sequence having 100% sequence identity to SEQ ID NO: 124 and a tracrRNA having 100% sequence identity to SEQ ID NO: 125, wherein said RGN polypeptide comprises an amino acid sequence having 100% sequence identity to SEQ ID NO: 123; and t) a gRNA comprising a CRISPR repeat sequence having 100% sequence identity to SEQ ID NO: 84 and a tracrRNA having 100% sequence identity to SEQ ID NO: 78, wherein said RGN polypeptide comprises an amino acid sequence having 100% sequence identity to SEQ ID NO: 83.

84. The system of any one of embodiments 71-83, wherein said target DNA sequence is located adjacent to a protospacer adjacent motif (PAM).

85. The system of any one of embodiments 71-84, wherein the target DNA sequence is within a cell.

86. The system of embodiment 85, wherein the cell is a eukaryotic cell.

87. The system of embodiment 86, wherein the eukaryotic cell is a plant cell.

88. The system of embodiment 86, wherein the eukaryotic cell is a mammalian cell.

89. The system of embodiment 88, wherein said mammalian cell is a human cell.

90. The system of embodiment 89, wherein said human cell is an immune cell.

91. The system of embodiment 90, wherein said immune cell is a stem cell.

92. The system of embodiment 91, wherein the stem cell is an induced pluripotent stem cell.

93. The system of embodiment 86, wherein the eukaryotic cell is an insect cell.

94. The system of embodiment 85, wherein the cell is a prokaryotic cell.

95. The system of any one of embodiments 71-94, wherein when transcribed the one or more guide RNAs is capable of hybridizing to the target DNA sequence and the guide RNA is capable of forming a complex with the RGN polypeptide to direct cleavage of the target DNA sequence.

96. The system of embodiment 95, wherein the cleavage generates a double-stranded break.

97. The system of embodiment 95, wherein the cleavage generates a single-stranded break.

98. The system of any one of embodiments 71-94, wherein said RGN polypeptide is nuclease inactive or is a nickase.

99. The system of any one of embodiments 71-98, wherein the RGN polypeptide is operably linked to a base-editing polypeptide.

100. The system of embodiment 99, wherein the base-editing polypeptide is a deaminase.

101. The system of embodiment 100, wherein the deaminase is a cytidine deaminase or an adenine deaminase.

102. The system of any one of embodiments 71-101, wherein the RGN polypeptide comprises one or more nuclear localization signals.

103. The system of any one of embodiments 71-102, wherein the RGN polypeptide is codon optimized for expression in a eukaryotic cell.

104. The system of any one of embodiments 71-103, wherein nucleotide sequences encoding the one or more guide RNAs and the nucleotide sequence encoding an RGN polypeptide are located on one vector.

105. The system of any one of embodiments 71-104, wherein said system further comprises one or more donor polynucleotides or one or more nucleotide sequences encoding the one or more donor polynucleotides.

106. A pharmaceutical composition comprising the nucleic acid molecule of any one of embodiments 1-14, 43-45, and 57-59, the vector of any one of embodiments 15-21, 46-56, and 60-70, the cell of embodiment 22, the isolated RGN polypeptide of any one of embodiments 31-42, or the system of any one of embodiments 71-105, and a pharmaceutically acceptable carrier.

107. A method for binding a target DNA sequence of a DNA molecule comprising delivering a system according to any one of embodiments 71-105, to said target DNA sequence or a cell comprising the target DNA sequence.

108. The method of embodiment 107, wherein said RGN polypeptide or said guide RNA further comprises a detectable label, thereby allowing for detection of said target DNA sequence.

109. The method of embodiment 107, wherein said guide RNA or said RGN polypeptide further comprises an expression modulator, thereby modulating expression of said target DNA sequence or a gene under transcriptional control by said target DNA sequence.

110. A method for cleaving or modifying a target DNA sequence of a DNA molecule comprising delivering a system according to any one of embodiments 71-105 to said target DNA sequence or a cell comprising the DNA molecule, and cleavage or modification of said target DNA sequence occurs.

111. The method of embodiment 110, wherein said modified target DNA sequence comprises insertion of heterologous DNA into the target DNA sequence.

112. The method of embodiment 110, wherein said modified target DNA sequence comprises deletion of at least one nucleotide from the target DNA sequence.

113. The method of embodiment 110, wherein said modified target DNA sequence comprises mutation of at least one nucleotide in the target DNA sequence.

114. A method for binding a target DNA sequence of a DNA molecule comprising:
a) assembling an RNA-guided nuclease (RGN) ribonucleotide complex in vitro by combining:
i) one or more guide RNAs capable of hybridizing to the target DNA sequence; and
ii) an RGN polypeptide comprising an amino acid sequence having at least 90% sequence identity to any one of SEQ ID NOs: 1, 8, 15, 22, 29, 36, 43, 50, 56, 63, 70, 76, 83, 89, 96, 103, 110, 117, 123, and 570-579; under conditions suitable for formation of the RGN ribonucleotide complex; and
b) contacting said target DNA sequence or a cell comprising said target DNA sequence with the in vitro-assembled RGN ribonucleotide complex;
wherein the one or more guide RNAs hybridize to the target DNA sequence, thereby directing said RGN polypeptide to bind to said target DNA sequence.

115. The method of embodiment 114, wherein said RGN polypeptide or said guide RNA further comprises a detectable label, thereby allowing for detection of said target DNA sequence.

116. The method of embodiment 114, wherein said guide RNA or said RGN polypeptide further comprises an expression modulator, thereby allowing for the modulation of expression of said target DNA sequence.

117. A method for cleaving and/or modifying a target DNA sequence of a DNA molecule, comprising contacting the DNA molecule with:

a) an RNA-guided nuclease (RGN) polypeptide, wherein said RGN comprises an amino acid sequence having at least 90% sequence identity to any one of SEQ ID NOs: 1, 8, 15, 22, 29, 36, 43, 50, 56, 63, 70, 76, 83, 89, 96, 103, 110, 117, 123, and 570-579; and
b) one or more guide RNAs capable of targeting the RGN of (a) to the target DNA sequence;
wherein the one or more guide RNAs hybridize to the target DNA sequence, thereby directing said RGN polypeptide to bind to said target DNA sequence and cleavage and/or modification of said target DNA sequence occurs.

118. The method of embodiment 117, wherein cleavage by said RGN polypeptide generates a double-stranded break.

119. The method of embodiment 117, wherein cleavage by said RGN polypeptide generates a single-stranded break.

120. The method of embodiment 117, wherein said RGN polypeptide is nuclease inactive or a nickase and is operably fused to a base-editing polypeptide.

121. The method of embodiment 120, wherein the base-editing polypeptide is a deaminase.

122. The method of embodiment 121, wherein the deaminase is a cytidine deaminase or an adenine deaminase.

123. The method of embodiment 117, wherein said modified target DNA sequence comprises insertion of heterologous DNA into the target DNA sequence.

124. The method of embodiment 117, wherein said modified target DNA sequence comprises deletion of at least one nucleotide from the target DNA sequence.

125. The method of embodiment 117, wherein said modified target DNA sequence comprises mutation of at least one nucleotide in the target DNA sequence.

126. The method of any one of embodiments 114-125, wherein said target DNA sequence is located adjacent to a protospacer adjacent motif (PAM).

127. The method of any one of embodiments 114-126, wherein said target DNA sequence is a eukaryotic target DNA sequence.

128. The method of any one of embodiments 114-127, wherein said gRNA is a single guide RNA (sgRNA).

129. The method of any one of embodiments 114-127, wherein said gRNA is a dual-guide RNA.

130. The method of any one of embodiments 114-129, wherein said RGN comprises an amino acid sequence having at least 95% sequence identity to any one of SEQ ID NOs: 1, 8, 15, 22, 29, 36, 43, 50, 56, 63, 70, 76, 83, 89, 96, 103, 110, 117, 123, and 570-579.

131. The method of any one of embodiments 114-129, wherein said RGN comprises an amino acid sequence having 100% sequence identity to any one of SEQ ID NOs: 1, 8, 15, 22, 29, 36, 43, 50, 56, 63, 70, 76, 83, 89, 96, 103, 110, 117, 123, and 570-579.

132. The method of any one of embodiments 114-129, wherein said RGN polypeptide has at least 90% sequence identity to SEQ ID NO: 63 and has an isoleucine at an amino acid position corresponding to 305, a valine at an amino acid position corresponding to 328, a leucine at an amino acid position corresponding to 366, a threonine at an amino acid position corresponding to 368, and a valine at an amino acid position corresponding to 405 of SEQ ID NO: 63.

133. The method of any one of embodiments 114-129, wherein:
a) said RGN has at least 90% sequence identity to SEQ ID NO: 1, said guideRNA comprises a crRNA repeat sequence having at least 90% sequence identity to SEQ ID NO: 2 and a tracrRNA having at least 90% sequence identity to SEQ ID NO: 3;
b) said RGN has at least 90% sequence identity to SEQ ID NO: 8, said guideRNA comprises a crRNA repeat sequence having at least 90% sequence identity to SEQ ID NO: 9 and a tracrRNA having at least 90% sequence identity to SEQ ID NO: 10;
c) said RGN has at least 90% sequence identity to SEQ ID NO: 15, said guideRNA comprises a crRNA repeat sequence having at least 90% sequence identity to SEQ ID NO: 16 and a tracrRNA having at least 90% sequence identity to SEQ ID NO: 17;
d) said RGN has at least 90% sequence identity to SEQ ID NO: 22, said guideRNA comprises a crRNA repeat sequence having at least 90% sequence identity to SEQ ID NO: 23 and a tracrRNA having at least 90% sequence identity to SEQ ID NO: 24;
e) said RGN has at least 90% sequence identity to SEQ ID NO: 29, said guideRNA comprises a crRNA repeat sequence having at least 90% sequence identity to SEQ ID NO: 30 and a tracrRNA having at least 90% sequence identity to SEQ ID NO: 31;
f) said RGN has at least 90% sequence identity to SEQ ID NO: 36, said guideRNA comprises a crRNA repeat sequence having at least 90% sequence identity to SEQ ID NO: 37 and a tracrRNA having at least 90% sequence identity to SEQ ID NO: 38;
g) said RGN has at least 90% sequence identity to SEQ ID NO: 43, said guideRNA comprises a crRNA repeat sequence having at least 90% sequence identity to SEQ ID NO: 44 and a tracrRNA having at least 90% sequence identity to SEQ ID NO: 45;
h) said RGN has at least 90% sequence identity to SEQ ID NO: 50, said guideRNA comprises a crRNA repeat sequence having at least 90% sequence identity to SEQ ID NO: 51 and a tracrRNA having at least 90% sequence identity to SEQ ID NO: 52;
i) said RGN has at least 90% sequence identity to SEQ ID NO: 56, said guideRNA comprises a crRNA repeat sequence having at least 90% sequence identity to SEQ ID NO: 57 and a tracrRNA having at least 90% sequence identity to SEQ ID NO: 58;
j) said RGN has at least 90% sequence identity to any one of SEQ ID NOs: 63 and 570-579, said guideRNA comprises a crRNA repeat sequence having at least 90% sequence identity to SEQ ID NO: 64 and a tracrRNA having at least 90% sequence identity to SEQ ID NO: 65;
k) said RGN has at least 90% sequence identity to SEQ ID NO: 70, said guideRNA comprises a crRNA repeat sequence having at least 90% sequence identity to SEQ ID NO: 71 and a tracrRNA having at least 90% sequence identity to SEQ ID NO: 72;
l) said RGN has at least 90% sequence identity to SEQ ID NO: 76, said guideRNA comprises a crRNA repeat sequence having at least 90% sequence identity to SEQ ID NO: 77 and a tracrRNA having at least 90% sequence identity to SEQ ID NO: 78;
m) said RGN has at least 90% sequence identity to SEQ ID NO: 83, said guideRNA comprises a crRNA repeat sequence having at least 90% sequence identity to SEQ ID NO: 84 and a tracrRNA having at least 90% sequence identity to SEQ ID NO: 85;
n) said RGN has at least 90% sequence identity to SEQ ID NO: 89, said guideRNA comprises a crRNA repeat sequence having at least 90% sequence identity to SEQ ID NO: 90 and a tracrRNA having at least 90% sequence identity to SEQ ID NO: 91;
o) said RGN has at least 90% sequence identity to SEQ ID NO: 96, said guideRNA comprises a crRNA repeat sequence having at least 90% sequence identity to SEQ ID NO: 97 and a tracrRNA having at least 90% sequence identity to SEQ ID NO: 98;
p) said RGN has at least 90% sequence identity to SEQ ID NO: 103, said guideRNA comprises a crRNA repeat sequence having at least 90% sequence identity to SEQ ID NO: 104 and a tracrRNA having at least 90% sequence identity to SEQ ID NO: 105;
q) said RGN has at least 90% sequence identity to SEQ ID NO: 110, said guideRNA comprises a crRNA repeat sequence having at least 90% sequence identity to SEQ ID NO: 111 and a tracrRNA having at least 90% sequence identity to SEQ ID NO: 112;
r) said RGN has at least 90% sequence identity to SEQ ID NO: 117, said guideRNA comprises a crRNA repeat sequence having at least 90% sequence identity to SEQ ID NO: 118 and a tracrRNA having at least 90% sequence identity to SEQ ID NO: 119;
s) said RGN has at least 90% sequence identity to SEQ ID NO: 123, said guideRNA comprises a crRNA repeat sequence having at least 90% sequence identity to SEQ ID NO: 124 and a tracrRNA having at least 90% sequence identity to SEQ ID NO: 125; or
t) said RGN has at least 90% sequence identity to SEQ ID NO: 83, said guideRNA comprises a crRNA repeat sequence having at least 90% sequence identity to SEQ ID NO: 84 and a tracrRNA having at least 90% sequence identity to SEQ ID NO: 78.
134. The method of any one of embodiments 114-129, wherein:
a) said RGN has at least 95% sequence identity to SEQ ID NO: 1, said guideRNA comprises a crRNA repeat sequence having at least 95% sequence identity to SEQ ID NO: 2 and a tracrRNA having at least 95% sequence identity to SEQ ID NO: 3;
b) said RGN has at least 95% sequence identity to SEQ ID NO: 8, said guideRNA comprises a crRNA repeat sequence having at least 95% sequence identity to SEQ ID NO: 9 and a tracrRNA having at least 95% sequence identity to SEQ ID NO: 10;
c) said RGN has at least 95% sequence identity to SEQ ID NO: 15, said guideRNA comprises a crRNA repeat sequence having at least 95% sequence identity to SEQ ID NO: 16 and a tracrRNA having at least 95% sequence identity to SEQ ID NO: 17;
d) said RGN has at least 95% sequence identity to SEQ ID NO: 22, said guideRNA comprises a crRNA repeat sequence having at least 95% sequence identity to SEQ ID NO: 23 and a tracrRNA having at least 95% sequence identity to SEQ ID NO: 24;
e) said RGN has at least 95% sequence identity to SEQ ID NO: 29, said guideRNA comprises a crRNA repeat sequence having at least 95% sequence identity to SEQ ID NO: 30 and a tracrRNA having at least 95% sequence identity to SEQ ID NO: 31;
f) said RGN has at least 95% sequence identity to SEQ ID NO: 36, said guideRNA comprises a crRNA repeat sequence having at least 95% sequence identity to SEQ ID NO: 37 and a tracrRNA having at least 95% sequence identity to SEQ ID NO: 38;
g) said RGN has at least 95% sequence identity to SEQ ID NO: 43, said guideRNA comprises a crRNA repeat sequence having at least 95% sequence identity to SEQ ID NO: 44 and a tracrRNA having at least 95% sequence identity to SEQ ID NO: 45;
h) said RGN has at least 95% sequence identity to SEQ ID NO: 50, said guideRNA comprises a crRNA repeat sequence having at least 95% sequence identity to SEQ ID NO: 51 and a tracrRNA having at least 95% sequence identity to SEQ ID NO: 52;
i) said RGN has at least 95% sequence identity to SEQ ID NO: 56, said guideRNA comprises a crRNA repeat sequence having at least 95% sequence identity to SEQ ID NO: 57 and a tracrRNA having at least 95% sequence identity to SEQ ID NO: 58;
j) said RGN has at least 95% sequence identity to any one of SEQ ID NOs: 63 and 570-579, said guideRNA comprises a crRNA repeat sequence having at least 95% sequence identity to SEQ ID NO: 64 and a tracrRNA having at least 95% sequence identity to SEQ ID NO: 65;
k) said RGN has at least 95% sequence identity to SEQ ID NO: 70, said guideRNA comprises a crRNA repeat sequence having at least 95% sequence identity to SEQ ID NO: 71 and a tracrRNA having at least 95% sequence identity to SEQ ID NO: 72;
l) said RGN has at least 95% sequence identity to SEQ ID NO: 76, said guideRNA comprises a crRNA repeat sequence having at least 95% sequence identity to SEQ ID NO: 77 and a tracrRNA having at least 95% sequence identity to SEQ ID NO: 78;
m) said RGN has at least 95% sequence identity to SEQ ID NO: 83, said guideRNA comprises a crRNA repeat sequence having at least 95% sequence identity to SEQ ID NO: 84 and a tracrRNA having at least 95% sequence identity to SEQ ID NO: 85;
n) said RGN has at least 95% sequence identity to SEQ ID NO: 89, said guideRNA comprises a crRNA repeat sequence having at least 95% sequence identity to SEQ ID NO: 90 and a tracrRNA having at least 95% sequence identity to SEQ ID NO: 91;
o) said RGN has at least 95% sequence identity to SEQ ID NO: 96, said guideRNA comprises a crRNA repeat sequence having at least 95% sequence identity to SEQ ID NO: 97 and a tracrRNA having at least 95% sequence identity to SEQ ID NO: 98;
p) said RGN has at least 95% sequence identity to SEQ ID NO: 103, said guideRNA comprises a crRNA repeat sequence having at least 95% sequence identity to SEQ ID NO: 104 and a tracrRNA having at least 95% sequence identity to SEQ ID NO: 105;
q) said RGN has at least 95% sequence identity to SEQ ID NO: 110, said guideRNA comprises a crRNA repeat sequence having at least 95% sequence identity to SEQ ID NO: 111 and a tracrRNA having at least 95% sequence identity to SEQ ID NO: 112;
r) said RGN has at least 95% sequence identity to SEQ ID NO: 117, said guideRNA comprises a crRNA repeat sequence having at least 95% sequence identity to SEQ ID NO: 118 and a tracrRNA having at least 95% sequence identity to SEQ ID NO: 119;
s) said RGN has at least 95% sequence identity to SEQ ID NO: 123, said guideRNA comprises a crRNA repeat sequence having at least 95% sequence identity to SEQ ID NO: 124 and a tracrRNA having at least 95% sequence identity to SEQ ID NO: 125; or
t) said RGN has at least 95% sequence identity to SEQ ID NO: 83, said guideRNA comprises a crRNA repeat sequence having at least 95% sequence identity to SEQ ID NO: 84 and a tracrRNA having at least 95% sequence identity to SEQ ID NO: 78.

135. The method of any one of embodiments 114-129, wherein:
a) said RGN has 100% sequence identity to SEQ ID NO: 1, said guideRNA comprises a crRNA repeat sequence having 100% sequence identity to SEQ ID NO: 2 and a tracrRNA having 100% sequence identity to SEQ ID NO: 3;
b) said RGN has 100% sequence identity to SEQ ID NO: 8, said guideRNA comprises a crRNA repeat sequence having 100% sequence identity to SEQ ID NO: 9 and a tracrRNA having 100% sequence identity to SEQ ID NO: 10;
c) said RGN has 100% sequence identity to SEQ ID NO: 15, said guideRNA comprises a crRNA repeat sequence having 100% sequence identity to SEQ ID NO: 16 and a tracrRNA having 100% sequence identity to SEQ ID NO: 17;
d) said RGN has 100% sequence identity to SEQ ID NO: 22, said guideRNA comprises a crRNA repeat sequence having 100% sequence identity to SEQ ID NO: 23 and a tracrRNA having 100% sequence identity to SEQ ID NO: 24;
e) said RGN has 100% sequence identity to SEQ ID NO: 29, said guideRNA comprises a crRNA repeat sequence having 100% sequence identity to SEQ ID NO: 30 and a tracrRNA having 100% sequence identity to SEQ ID NO: 31;
f) said RGN has 100% sequence identity to SEQ ID NO: 36, said guideRNA comprises a crRNA repeat sequence having 100% sequence identity to SEQ ID NO: 37 and a tracrRNA having 100% sequence identity to SEQ ID NO: 38;
g) said RGN has 100% sequence identity to SEQ ID NO: 43, said guideRNA comprises a crRNA repeat sequence having 100% sequence identity to SEQ ID NO: 44 and a tracrRNA having 100% sequence identity to SEQ ID NO: 45;
h) said RGN has 100% sequence identity to SEQ ID NO: 50, said guideRNA comprises a crRNA repeat sequence having 100% sequence identity to SEQ ID NO: 51 and a tracrRNA having 100% sequence identity to SEQ ID NO: 52;
i) said RGN has 100% sequence identity to SEQ ID NO: 56, said guideRNA comprises a crRNA repeat sequence having 100% sequence identity to SEQ ID NO: 57 and a tracrRNA having 100% sequence identity to SEQ ID NO: 58;
j) said RGN has 100% sequence identity to any one of SEQ ID NOs: 63 and 570-579, said guideRNA comprises a crRNA repeat sequence having 100% sequence identity to SEQ ID NO: 64 and a tracrRNA having 100% sequence identity to SEQ ID NO: 65;
k) said RGN has 100% sequence identity to SEQ ID NO: 70, said guideRNA comprises a crRNA repeat sequence having 100% sequence identity to SEQ ID NO: 71 and a tracrRNA having 100% sequence identity to SEQ ID NO: 72;
l) said RGN has 100% sequence identity to SEQ ID NO: 76, said guideRNA comprises a crRNA repeat sequence having 100% sequence identity to SEQ ID NO: 77 and a tracrRNA having 100% sequence identity to SEQ ID NO: 78;
m) said RGN has 100% sequence identity to SEQ ID NO: 83, said guideRNA comprises a crRNA repeat sequence having 100% sequence identity to SEQ ID NO: 84 and a tracrRNA having 100% sequence identity to SEQ ID NO: 85;
n) said RGN has 100% sequence identity to SEQ ID NO: 89, said guideRNA comprises a crRNA repeat sequence having 100% sequence identity to SEQ ID NO: 90 and a tracrRNA having 100% sequence identity to SEQ ID NO: 91;
o) said RGN has 100% sequence identity to SEQ ID NO: 96, said guideRNA comprises a crRNA repeat sequence having 100% sequence identity to SEQ ID NO: 97 and a tracrRNA having 100% sequence identity to SEQ ID NO: 98;
p) said RGN has 100% sequence identity to SEQ ID NO: 103, said guideRNA comprises a crRNA repeat sequence having 100% sequence identity to SEQ ID NO: 104 and a tracrRNA having 100% sequence identity to SEQ ID NO: 105;
q) said RGN has 100% sequence identity to SEQ ID NO: 110, said guideRNA comprises a crRNA repeat sequence having 100% sequence identity to SEQ ID NO: 111 and a tracrRNA having 100% sequence identity to SEQ ID NO: 112;
r) said RGN has 100% sequence identity to SEQ ID NO: 117, said guideRNA comprises a crRNA repeat sequence having 100% sequence identity to SEQ ID NO: 118 and a tracrRNA having 100% sequence identity to SEQ ID NO: 119;
s) said RGN has 100% sequence identity to SEQ ID NO: 123, said guideRNA comprises a crRNA repeat sequence having 100% sequence identity to SEQ ID NO: 124 and a tracrRNA having 100% sequence identity to SEQ ID NO: 125; or
t) said RGN has 100% sequence identity to SEQ ID NO: 83, said guideRNA comprises a crRNA repeat sequence having 100% sequence identity to SEQ ID NO: 84 and a tracrRNA having 100% sequence identity to SEQ ID NO: 78.

136. The method of any one of embodiments 107-135, wherein the target DNA sequence is within a cell.
137. The method of embodiment 136, wherein the cell is a eukaryotic cell.
138. The method of embodiment 137, wherein the eukaryotic cell is a plant cell.
139. The method of embodiment 137, wherein the eukaryotic cell is a mammalian cell.
140. The method of embodiment 139, wherein said mammalian cell is a human cell.
141. The method of embodiment 140, wherein said human cell is an immune cell.
142. The method of embodiment 141, wherein said immune cell is a stem cell.
143. The method of embodiment 142, wherein said stem cell is an induced pluripotent stem cell.
144. The method of embodiment 137, wherein the eukaryotic cell is an insect cell.
145. The method of embodiment 136, wherein the cell is a prokaryotic cell.
146. The method of any one of embodiments 136-145, further comprising culturing the cell under conditions in which the RGN polypeptide is expressed and cleaves the target DNA sequence to produce a DNA molecule comprising a modified DNA sequence; and selecting a cell comprising said modified target DNA sequence.
147. A cell comprising a modified target DNA sequence according to the method of embodiment 146.
148. The cell of embodiment 147, wherein the cell is a eukaryotic cell.
149. The cell of embodiment 148, wherein the eukaryotic cell is a plant cell.
150. A plant comprising the cell of embodiment 149.
151. A seed comprising the cell of embodiment 149.
152. The cell of embodiment 148, wherein the eukaryotic cell is a mammalian cell.
153. The cell of embodiment 152, wherein said mammalian cell is a human cell.
154. The cell of embodiment 153, wherein said human cell is an immune cell.
155. The cell of embodiment 154, wherein said immune cell is a stem cell.
156. The cell of embodiment 155, wherein said stem cell is an induced pluripotent stem cell.
157. The cell of embodiment 148, wherein the eukaryotic cell is an insect cell.
158. The cell of embodiment 147, wherein the cell is a prokaryotic cell.
159. A pharmaceutical composition comprising the cell of any one of embodiments 148 and 152-156 and a pharmaceutically acceptable carrier.
160. A method for producing a genetically modified cell with a correction in a causal mutation for a genetically inherited disease, the method comprising introducing into the cell:
a) an RNA-guided nuclease (RGN) polypeptide, wherein the RGN polypeptide comprises an amino acid sequence having at least 90% sequence identity to SEQ ID NOs: 1, 8, 15, 22, 29, 36, 43, 50, 56, 63, 70, 76, 83, 89, 96, 103, 110, 117, 123, or 570-579, or a polynucleotide encoding said RGN polypeptide, wherein said polynucleotide encoding the RGN polypeptide is operably linked to a promoter to enable expression of the RGN polypeptide in the cell; and
b) a guide RNA (gRNA) or a polynucleotide encoding said gRNA, wherein said polynucleotide encoding the gRNA is operably linked to a promoter to enable expression of the gRNA in the cell
whereby the RGN and gRNA target to the genomic location of the causal mutation and modify the genomic sequence to remove the causal mutation.
161. The method of embodiment 160, wherein the RGN is nuclease inactive or a nickase and is fused to a polypeptide which has base-editing activity.
162. The method of embodiment 161, wherein the base-editing polypeptide is a deaminase.
163. The method of embodiment 162, wherein the polypeptide with base-editing activity is a cytidine deaminase or an adenine deaminase.
164. The method of any one of embodiments 160-163, wherein the genetically inherited disease is caused by a single nucleotide polymorphism.
165. The method of any one of embodiments 160-163, wherein the genetically inherited disease is Hurler Syndrome.
166. The method of any one of embodiments 160-163, wherein the gRNA further comprises a spacer sequence that targets a region proximal to the causal single nucleotide polymorphism.

167. A method for producing a genetically modified cell with a deletion in a disease-causing genomic region of instability, the method comprising introducing into the cell:
   a) an RNA-guided nuclease (RGN) polypeptide, wherein the RGN polypeptide comprises an amino acid sequence having at least 90% sequence identity to SEQ ID NOs: 1, 8, 15, 22, 29, 36, 43, 50, 56, 63, 70, 76, 83, 89, 96, 103, 110, 117, 123, or 570-579, or a polynucleotide encoding said RGN polypeptide, wherein said polynucleotide encoding the RGN polypeptide is operably linked to a promoter to enable expression of the RGN polypeptide in the cell; and
   b) a first guide RNA (gRNA) or a polynucleotide encoding said gRNA, wherein said polynucleotide encoding the gRNA is operably linked to a promoter to enable expression of the gRNA in the cell, and further wherein the gRNA comprises a spacer sequence that targets the 5' flank of the genomic region of instability; and
   c) a second guide RNA (gRNA) or a polynucleotide encoding said gRNA, wherein said polynucleotide encoding the gRNA is operably linked to a promoter to enable expression of the gRNA in the cell, and further wherein said second gRNA comprises a spacer sequence that targets the 3' flank of the genomic region of instability;
   whereby the RGN and the two gRNAs target to the genomic region of instability and at least a portion of the genomic region of instability is removed.
168. The method of embodiment 167, wherein the genetically inherited disease is Friedrich's Ataxia or Huntington's Disease.
169. The method of embodiment 167, wherein the first gRNA further comprises a spacer sequence that targets a region within or proximal to the genomic region of instability.
170. The method of embodiment 169, wherein the second gRNA further comprises a spacer sequence that targets a region within or proximal to the genomic region of instability.
171. The method of any one of embodiments 160-170, wherein said RGN polypeptide has at least 95% sequence identity to any one of SEQ ID NOs: 1, 8, 15, 22, 29, 36, 43, 50, 56, 63, 70, 76, 83, 89, 96, 103, 110, 117, 123, or 570-579.
172. The method of any one of embodiments 160-170, wherein said RGN polypeptide has 100% sequence identity to any one of SEQ ID NOs: 1, 8, 15, 22, 29, 36, 43, 50, 56, 63, 70, 76, 83, 89, 96, 103, 110, 117, 123, or 570-579.
173. The method of any one of embodiments 160-170, wherein said RGN polypeptide has at least 90% sequence identity to SEQ ID NO: 63 and has an isoleucine at an amino acid position corresponding to 305, a valine at an amino acid position corresponding to 328, a leucine at an amino acid position corresponding to 366, a threonine at an amino acid position corresponding to 368, and a valine at an amino acid position corresponding to 405 of SEQ ID NO: 63.
174. The method of any one of embodiments 160-170, wherein said gRNA, said first gRNA, said second gRNA, or said first gRNA and said second gRNA is selected from a gRNA selected from the group consisting of:
   a) a gRNA comprising a CRISPR repeat sequence having at least 90% sequence identity to SEQ ID NO: 2 and a tracrRNA having at least 90% sequence identity to SEQ ID NO: 3, wherein said RGN polypeptide has an amino acid sequence having at least 90% sequence identity to SEQ ID NO: 1;
   b) a gRNA comprising a CRISPR repeat sequence having at least 90% sequence identity to SEQ ID NO: 9 and a tracrRNA having at least 90% sequence identity to SEQ ID NO: 10, wherein said RGN polypeptide has an amino acid sequence having at least 90% sequence identity to SEQ ID NO: 8;
   c) a gRNA comprising a CRISPR repeat sequence having at least 90% sequence identity to SEQ ID NO: 16 and a tracrRNA having at least 90% sequence identity to SEQ ID NO: 17, wherein said RGN polypeptide has an amino acid sequence having at least 90% sequence identity to SEQ ID NO: 15;
   d) a gRNA comprising a CRISPR repeat sequence having at least 90% sequence identity to SEQ ID NO: 23 and a tracrRNA having at least 90% sequence identity to SEQ ID NO: 24, wherein said RGN polypeptide has an amino acid sequence having at least 90% sequence identity to SEQ ID NO: 22;
   e) a gRNA comprising a CRISPR repeat sequence having at least 90% sequence identity to SEQ ID NO: 30 and a tracrRNA having at least 90% sequence identity to SEQ ID NO: 31, wherein said RGN polypeptide has an amino acid sequence having at least 90% sequence identity to SEQ ID NO: 29;
   f) a gRNA comprising a CRISPR repeat sequence having at least 90% sequence identity to SEQ ID NO: 37 and a tracrRNA having at least 90% sequence identity to SEQ ID NO: 38, wherein said RGN polypeptide has an amino acid sequence having at least 90% sequence identity to SEQ ID NO: 36;
   g) a gRNA comprising a CRISPR repeat sequence having at least 90% sequence identity to SEQ ID NO: 44 and a tracrRNA having at least 90% sequence identity to SEQ ID NO: 45, wherein said RGN polypeptide has an amino acid sequence having at least 90% sequence identity to SEQ ID NO: 43;
   h) a gRNA comprising a CRISPR repeat sequence having at least 90% sequence identity to SEQ ID NO: 51 and a tracrRNA having at least 90% sequence identity to SEQ ID NO: 52, wherein said RGN polypeptide has an amino acid sequence having at least 90% sequence identity to SEQ ID NO: 50;
   i) a gRNA comprising a CRISPR repeat sequence having at least 90% sequence identity to SEQ ID NO: 57 and a tracrRNA having at least 90% sequence identity to SEQ ID NO: 58, wherein said RGN polypeptide has an amino acid sequence having at least 90% sequence identity to SEQ ID NO: 56;
   j) a gRNA comprising a CRISPR repeat sequence having at least 90% sequence identity to SEQ ID NO: 64 and a tracrRNA having at least 90% sequence identity to SEQ ID NO: 65, wherein said RGN polypeptide has an amino acid sequence having at least 90% sequence identity to any one of SEQ ID NOs: 63 and 570-579;
   k) a gRNA comprising a CRISPR repeat sequence having at least 90% sequence identity to SEQ ID NO: 71 and a tracrRNA having at least 90% sequence identity to SEQ ID NO: 72, wherein said RGN polypeptide has an amino acid sequence having at least 90% sequence identity to SEQ ID NO: 70;
   l) a gRNA comprising a CRISPR repeat sequence having at least 90% sequence identity to SEQ ID NO: 77 and a tracrRNA having at least 90% sequence identity to SEQ ID NO: 78, wherein said RGN polypeptide has an amino acid sequence having at least 90% sequence identity to SEQ ID NO: 76;
m) a gRNA comprising a CRISPR repeat sequence having at least 90% sequence identity to SEQ ID NO: 84 and a tracrRNA having at least 90% sequence identity to SEQ ID NO: 85, wherein said RGN polypeptide has an amino acid sequence having at least 90% sequence identity to SEQ ID NO: 83;
n) a gRNA comprising a CRISPR repeat sequence having at least 90% sequence identity to SEQ ID NO: 90 and a tracrRNA having at least 90% sequence identity to SEQ ID NO: 91, wherein said RGN polypeptide has an amino acid sequence having at least 90% sequence identity to SEQ ID NO: 89;
o) a gRNA comprising a CRISPR repeat sequence having at least 90% sequence identity to SEQ ID NO: 97 and a tracrRNA having at least 90% sequence identity to SEQ ID NO: 98, wherein said RGN polypeptide has an amino acid sequence having at least 90% sequence identity to SEQ ID NO: 96;
p) a gRNA comprising a CRISPR repeat sequence having at least 90% sequence identity to SEQ ID NO: 104 and a tracrRNA having at least 90% sequence identity to SEQ ID NO: 105, wherein said RGN polypeptide has an amino acid sequence having at least 90% sequence identity to SEQ ID NO: 103;
q) a gRNA comprising a CRISPR repeat sequence having at least 90% sequence identity to SEQ ID NO: 111 and a tracrRNA having at least 90% sequence identity to SEQ ID NO: 112, wherein said RGN polypeptide has an amino acid sequence having at least 90% sequence identity to SEQ ID NO: 110;
r) a gRNA comprising a CRISPR repeat sequence having at least 90% sequence identity to SEQ ID NO: 118 and a tracrRNA having at least 90% sequence identity to SEQ ID NO: 119, wherein said RGN polypeptide has an amino acid sequence having at least 90% sequence identity to SEQ ID NO: 117;
s) a gRNA comprising a CRISPR repeat sequence having at least 90% sequence identity to SEQ ID NO: 124 and a tracrRNA having at least 90% sequence identity to SEQ ID NO: 125, wherein said RGN polypeptide has an amino acid sequence having at least 90% sequence identity to SEQ ID NO: 123; and
t) a gRNA comprising a CRISPR repeat sequence having at least 90% sequence identity to SEQ ID NO: 84 and a tracrRNA having at least 90% sequence identity to SEQ ID NO: 78, wherein said RGN polypeptide has an amino acid sequence having at least 90% sequence identity to SEQ ID NO: 83.

175. The method of any one of embodiments 160-170, wherein said gRNA, said first gRNA, said second gRNA, or said first gRNA and said second gRNA is selected from a gRNA selected from the group consisting of:
a) a gRNA comprising a CRISPR repeat sequence having at least 95% sequence identity to SEQ ID NO: 2 and a tracrRNA having at least 95% sequence identity to SEQ ID NO: 3, wherein said RGN polypeptide has an amino acid sequence having at least 95% sequence identity to SEQ ID NO: 1;
b) a gRNA comprising a CRISPR repeat sequence having at least 95% sequence identity to SEQ ID NO: 9 and a tracrRNA having at least 95% sequence identity to SEQ ID NO: 10, wherein NO: 8;
c) a gRNA comprising a CRISPR repeat sequence having at least 95% sequence identity to SEQ ID NO: 16 and a tracrRNA having at least 95% sequence identity to SEQ ID NO: 17, wherein said RGN polypeptide has an amino acid sequence having at least 95% sequence identity to SEQ ID NO: 15;
d) a gRNA comprising a CRISPR repeat sequence having at least 95% sequence identity to SEQ ID NO: 23 and a tracrRNA having at least 95% sequence identity to SEQ ID NO: 24, wherein said RGN polypeptide has an amino acid sequence having at least 95% sequence identity to SEQ ID NO: 22;
e) a gRNA comprising a CRISPR repeat sequence having at least 95% sequence identity to SEQ ID NO: 30 and a tracrRNA having at least 95% sequence identity to SEQ ID NO: 31, wherein said RGN polypeptide has an amino acid sequence having at least 95% sequence identity to SEQ ID NO: 29;
f) a gRNA comprising a CRISPR repeat sequence having at least 95% sequence identity to SEQ ID NO: 37 and a tracrRNA having at least 95% sequence identity to SEQ ID NO: 38, wherein said RGN polypeptide has an amino acid sequence having at least 95% sequence identity to SEQ ID NO: 36;
g) a gRNA comprising a CRISPR repeat sequence having at least 95% sequence identity to SEQ ID NO: 44 and a tracrRNA having at least 95% sequence identity to SEQ ID NO: 45, wherein said RGN polypeptide has an amino acid sequence having at least 95% sequence identity to SEQ ID NO: 43;
h) a gRNA comprising a CRISPR repeat sequence having at least 95% sequence identity to SEQ ID NO: 51 and a tracrRNA having at least 95% sequence identity to SEQ ID NO: 52, wherein said RGN polypeptide has an amino acid sequence having at least 95% sequence identity to SEQ ID NO: 50;
i) a gRNA comprising a CRISPR repeat sequence having at least 95% sequence identity to SEQ ID NO: 57 and a tracrRNA having at least 95% sequence identity to SEQ ID NO: 58, wherein said RGN polypeptide has an amino acid sequence having at least 95% sequence identity to SEQ ID NO: 56;
j) a gRNA comprising a CRISPR repeat sequence having at least 95% sequence identity to SEQ ID NO: 64 and a tracrRNA having at least 95% sequence identity to SEQ ID NO: 65, wherein said RGN polypeptide has an amino acid sequence having at least 95% sequence identity to any one of SEQ ID NOs: 63 and 570-579;
k) a gRNA comprising a CRISPR repeat sequence having at least 95% sequence identity to SEQ ID NO: 71 and a tracrRNA having at least 95% sequence identity to SEQ ID NO: 72, wherein NO: 70;
l) a gRNA comprising a CRISPR repeat sequence having at least 95% sequence identity to SEQ ID NO: 77 and a tracrRNA having at least 95% sequence identity to SEQ ID NO: 78, wherein said RGN polypeptide has an amino acid sequence having at least 95% sequence identity to SEQ ID NO: 76;
m) a gRNA comprising a CRISPR repeat sequence having at least 95% sequence identity to SEQ ID NO: 84 and a tracrRNA having at least 95% sequence identity to SEQ ID NO: 85, wherein said RGN polypeptide has an amino acid sequence having at least 95% sequence identity to SEQ ID NO: 83;
n) a gRNA comprising a CRISPR repeat sequence having at least 95% sequence identity to SEQ ID NO: 90 and a tracrRNA having at least 95% sequence identity to SEQ ID NO: 91, wherein said RGN polypeptide has an amino acid sequence having at least 95% sequence identity to SEQ ID NO: 89;
o) a gRNA comprising a CRISPR repeat sequence having at least 95% sequence identity to SEQ ID NO: 97 and a tracrRNA having at least 95% sequence identity to SEQ ID NO: 98, wherein said RGN polypeptide has an amino acid sequence having at least 95% sequence identity to SEQ ID NO: 96;
p) a gRNA comprising a CRISPR repeat sequence having at least 95% sequence identity to SEQ ID NO: 104 and a tracrRNA having at least 95% sequence identity to SEQ ID NO: 105, wherein said RGN polypeptide has an amino acid sequence having at least 95% sequence identity to SEQ ID NO: 103;
q) a gRNA comprising a CRISPR repeat sequence having at least 95% sequence identity to SEQ ID NO: 111 and a tracrRNA having at least 95% sequence identity to SEQ ID NO: 112, wherein said RGN polypeptide has an amino acid sequence having at least 95% sequence identity to SEQ ID NO: 110;
r) a gRNA comprising a CRISPR repeat sequence having at least 95% sequence identity to SEQ ID NO: 118 and a tracrRNA having at least 95% sequence identity to SEQ ID NO: 119, wherein said RGN polypeptide has an amino acid sequence having at least 95% sequence identity to SEQ ID NO: 117;
s) a gRNA comprising a CRISPR repeat sequence having at least 95% sequence identity to SEQ ID NO: 124 and a tracrRNA having at least 95% sequence identity to SEQ ID NO: 125, wherein said RGN polypeptide has an amino acid sequence having at least 95% sequence identity to SEQ ID NO: 123; and
t) a gRNA comprising a CRISPR repeat sequence having at least 95% sequence identity to SEQ ID NO: 84 and a tracrRNA having at least 95% sequence identity to SEQ ID NO: 78, wherein NO: 83.

176. The method of any one of embodiments 160-170, wherein said gRNA, said first gRNA, said second gRNA, or said first gRNA and said second gRNA is selected from a gRNA selected from the group consisting of:
a) a gRNA comprising a CRISPR repeat sequence having 100% sequence identity to SEQ ID NO: 2 and a tracrRNA having 100% sequence identity to SEQ ID NO: 3, wherein said RGN polypeptide has an amino acid sequence having 100% sequence identity to SEQ ID NO: 1;
b) a gRNA comprising a CRISPR repeat sequence having 100% sequence identity to SEQ ID NO: 9 and a tracrRNA having 100% sequence identity to SEQ ID NO: 10, wherein said RGN polypeptide has an amino acid sequence having 100% sequence identity to SEQ ID NO: 8;
c) a gRNA comprising a CRISPR repeat sequence having 100% sequence identity to SEQ ID NO: 16 and a tracrRNA having 100% sequence identity to SEQ ID NO: 17, wherein said RGN polypeptide has an amino acid sequence having 100% sequence identity to SEQ ID NO: 15;
d) a gRNA comprising a CRISPR repeat sequence having 100% sequence identity to SEQ ID NO: 23 and a tracrRNA having 100% sequence identity to SEQ ID NO: 24, wherein said RGN polypeptide has an amino acid sequence having 100% sequence identity to SEQ ID NO: 22;
e) a gRNA comprising a CRISPR repeat sequence having 100% sequence identity to SEQ ID NO: 30 and a tracrRNA having 100% sequence identity to SEQ ID NO: 31, wherein said RGN polypeptide has an amino acid sequence having 100% sequence identity to SEQ ID NO: 29;
f) a gRNA comprising a CRISPR repeat sequence having 100% sequence identity to SEQ ID NO: 37 and a tracrRNA having 100% sequence identity to SEQ ID NO: 38, wherein said RGN polypeptide has an amino acid sequence having 100% sequence identity to SEQ ID NO: 36;
g) a gRNA comprising a CRISPR repeat sequence having 100% sequence identity to SEQ ID NO: 44 and a tracrRNA having 100% sequence identity to SEQ ID NO: 45, wherein said RGN polypeptide has an amino acid sequence having 100% sequence identity to SEQ ID NO: 43;
h) a gRNA comprising a CRISPR repeat sequence having 100% sequence identity to SEQ ID NO: 51 and a tracrRNA having 100% sequence identity to SEQ ID NO: 52, wherein said RGN polypeptide has an amino acid sequence having 100% sequence identity to SEQ ID NO: 50;
i) a gRNA comprising a CRISPR repeat sequence having 100% sequence identity to SEQ ID NO: 57 and a tracrRNA having 100% sequence identity to SEQ ID NO: 58, wherein said RGN polypeptide has an amino acid sequence having 100% sequence identity to SEQ ID NO: 56;
j) a gRNA comprising a CRISPR repeat sequence having 100% sequence identity to SEQ ID NO: 64 and a tracrRNA having 100% sequence identity to SEQ ID NO: 65, wherein said RGN polypeptide has an amino acid sequence having 100% sequence identity to any one of SEQ ID NOs: 63 and 570-579;
k) a gRNA comprising a CRISPR repeat sequence having 100% sequence identity to SEQ ID NO: 71 and a tracrRNA having 100% sequence identity to SEQ ID NO: 72, wherein said RGN polypeptide has an amino acid sequence having 100% sequence identity to SEQ ID NO: 70;
l) a gRNA comprising a CRISPR repeat sequence having 100% sequence identity to SEQ ID NO: 77 and a tracrRNA having 100% sequence identity to SEQ ID NO: 78, wherein said RGN polypeptide has an amino acid sequence having 100% sequence identity to SEQ ID NO: 76;
m) a gRNA comprising a CRISPR repeat sequence having 100% sequence identity to SEQ ID NO: 84 and a tracrRNA having 100% sequence identity to SEQ ID NO: 85, wherein said RGN polypeptide has an amino acid sequence having 100% sequence identity to SEQ ID NO: 83;
n) a gRNA comprising a CRISPR repeat sequence having 100% sequence identity to SEQ ID NO: 90 and a tracrRNA having 100% sequence identity to SEQ ID NO: 91, wherein said RGN polypeptide has an amino acid sequence having 100% sequence identity to SEQ ID NO: 89;
o) a gRNA comprising a CRISPR repeat sequence having 100% sequence identity to SEQ ID NO: 97 and a tracrRNA having 100% sequence identity to SEQ ID NO: 98, wherein said RGN polypeptide has an amino acid sequence having 100% sequence identity to SEQ ID NO: 96;
p) a gRNA comprising a CRISPR repeat sequence having 100% sequence identity to SEQ ID NO: 104 and a tracrRNA having 100% sequence identity to SEQ ID NO: 105, wherein said RGN polypeptide has an amino acid sequence having 100% sequence identity to SEQ ID NO: 103;
q) a gRNA comprising a CRISPR repeat sequence having 100% sequence identity to SEQ ID NO: 111 and a tracrRNA having 100% sequence identity to SEQ ID NO: 112, wherein said RGN polypeptide has an amino acid sequence having 100% sequence identity to SEQ ID NO: 110;
r) a gRNA comprising a CRISPR repeat sequence having 100% sequence identity to SEQ ID NO: 118 and a tracrRNA having 100% sequence identity to SEQ ID NO: 119, wherein said RGN polypeptide has an amino acid sequence having 100% sequence identity to SEQ ID NO: 117;
s) a gRNA comprising a CRISPR repeat sequence having 100% sequence identity to SEQ ID NO: 124 and a tracrRNA having 100% sequence identity to SEQ ID NO: 125, wherein said RGN polypeptide has an amino acid sequence having 100% sequence identity to SEQ ID NO: 123; and
t) a gRNA comprising a CRISPR repeat sequence having 100% sequence identity to SEQ ID NO: 84 and a tracrRNA having 100% sequence identity to SEQ ID NO: 78, wherein said RGN polypeptide has an amino acid sequence having 100% sequence identity to SEQ ID NO: 83.

177. The method of any one of embodiments 160-176, wherein the cell is an animal cell.

178. The method of embodiment 177, wherein the animal cell is a mammalian cell.

179. The method of embodiment 177, wherein the cell is derived from a dog, cat, mouse, rat, rabbit, horse, cow, pig, or human.

180. A method for producing a genetically modified mammalian hematopoietic progenitor cell having decreased BCL11A mRNA and protein expression, the method comprising introducing into an isolated human hematopoietic progenitor cell:
a) an RNA-guided nuclease (RGN) polypeptide, wherein the RGN polypeptide comprises an amino acid sequence having at least 90% sequence identity to SEQ ID NOs: 1, 8, 15, 22, 29, 36, 43, 50, 56, 63, 70, 76, 83, 89, 96, 103, 110, 117, 123, or 570-579, or a polynucleotide encoding said RGN polypeptide, wherein said polynucleotide encoding the RGN polypeptide is operably linked to a promoter to enable expression of the RGN polypeptide in the cell; and
b) a guide RNA (gRNA) or a polynucleotide encoding said gRNA, wherein said polynucleotide encoding the gRNA is operably linked to a promoter to enable expression of the gRNA in the cell,
whereby the RGN and gRNA are expressed in the cell and cleave at the BCL11A enhancer region, resulting in genetic modification of the human hematopoietic progenitor cell and reducing the mRNA and/or protein expression of BCL11A.

181. The method of embodiment 180, wherein said RGN polypeptide has at least 95% sequence identity to any one of SEQ ID NOs: 1, 8, 15, 22, 29, 36, 43, 50, 56, 63, 70, 76, 83, 89, 96, 103, 110, 117, 123, or 570-579.

182. The method of embodiment 180, wherein said RGN polypeptide has 100% sequence identity to any one of SEQ ID NOs: 1, 8, 15, 22, 29, 36, 43, 50, 56, 63, 70, 76, 83, 89, 96, 103, 110, 117, 123, or 570-579.

183. The method of embodiment 180, wherein said RGN polypeptide has at least 90% sequence identity to SEQ ID NO: 63 and has an isoleucine at an amino acid position corresponding to 305, a valine at an amino acid position corresponding to 328, a leucine at an amino acid position corresponding to 366, a threonine at an amino acid position corresponding to 368, and a valine at an amino acid position corresponding to 405 of SEQ ID NO: 63.

184. The method of embodiment 180, wherein said gRNA is selected from the group consisting of:
a) a gRNA comprising a CRISPR repeat sequence having at least 90% sequence identity to SEQ ID NO: 2 and a tracrRNA having at least 90% sequence identity to SEQ ID NO: 3, wherein said RGN polypeptide has an amino acid sequence having at least 90% sequence identity to SEQ ID NO: 1;
b) a gRNA comprising a CRISPR repeat sequence having at least 90% sequence identity to SEQ ID NO: 9 and a tracrRNA having at least 90% sequence identity to SEQ ID NO: 10, wherein said RGN polypeptide has an amino acid sequence having at least 90% sequence identity to SEQ ID NO: 8;
c) a gRNA comprising a CRISPR repeat sequence having at least 90% sequence identity to SEQ ID NO: 16 and a tracrRNA having at least 90% sequence identity to SEQ ID NO: 17, wherein said RGN polypeptide has an amino acid sequence having at least 90% sequence identity to SEQ ID NO: 15;
d) a gRNA comprising a CRISPR repeat sequence having at least 90% sequence identity to SEQ ID NO: 23 and a tracrRNA having at least 90% sequence identity to SEQ ID NO: 24, wherein said RGN polypeptide has an amino acid sequence having at least 90% sequence identity to SEQ ID NO: 22;
e) a gRNA comprising a CRISPR repeat sequence having at least 90% sequence identity to SEQ ID NO: 30 and a tracrRNA having at least 90% sequence identity to SEQ ID NO: 31, wherein said RGN polypeptide has an amino acid sequence having at least 90% sequence identity to SEQ ID NO: 29;
f) a gRNA comprising a CRISPR repeat sequence having at least 90% sequence identity to SEQ ID NO: 37 and a tracrRNA having at least 90% sequence identity to SEQ ID NO: 38, wherein said RGN polypeptide has an amino acid sequence having at least 90% sequence identity to SEQ ID NO: 36;
g) a gRNA comprising a CRISPR repeat sequence having at least 90% sequence identity to SEQ ID NO: 44 and a tracrRNA having at least 90% sequence identity to SEQ ID NO: 45, wherein said RGN polypeptide has an amino acid sequence having at least 90% sequence identity to SEQ ID NO: 43;
h) a gRNA comprising a CRISPR repeat sequence having at least 90% sequence identity to SEQ ID NO: 51 and a tracrRNA having at least 90% sequence identity to SEQ ID NO: 52, wherein said RGN polypeptide has an amino acid sequence having at least 90% sequence identity to SEQ ID NO: 50;
i) a gRNA comprising a CRISPR repeat sequence having at least 90% sequence identity to SEQ ID NO: 57 and a tracrRNA having at least 90% sequence identity to SEQ ID NO: 58, wherein said RGN polypeptide has an amino acid sequence having at least 90% sequence identity to SEQ ID NO: 56;
j) a gRNA comprising a CRISPR repeat sequence having at least 90% sequence identity to SEQ ID NO: 64 and a tracrRNA having at least 90% sequence identity to SEQ ID NO: 65, wherein said RGN polypeptide has an amino acid sequence having at least 90% sequence identity to any one of SEQ ID NOs: 63 and 570-579;

k) a gRNA comprising a CRISPR repeat sequence having at least 90% sequence identity to SEQ ID NO: 71 and a tracrRNA having at least 90% sequence identity to SEQ ID NO: 72, wherein said RGN polypeptide has an amino acid sequence having at least 90% sequence identity to SEQ ID NO: 70;

l) a gRNA comprising a CRISPR repeat sequence having at least 90% sequence identity to SEQ ID NO: 77 and a tracrRNA having at least 90% sequence identity to SEQ ID NO: 78, wherein said RGN polypeptide has an amino acid sequence having at least 90% sequence identity to SEQ ID NO: 76;

m) a gRNA comprising a CRISPR repeat sequence having at least 90% sequence identity to SEQ ID NO: 84 and a tracrRNA having at least 90% sequence identity to SEQ ID NO: 85, wherein said RGN polypeptide has an amino acid sequence having at least 90% sequence identity to SEQ ID NO: 83;

n) a gRNA comprising a CRISPR repeat sequence having at least 90% sequence identity to SEQ ID NO: 90 and a tracrRNA having at least 90% sequence identity to SEQ ID NO: 91, wherein said RGN polypeptide has an amino acid sequence having at least 90% sequence identity to SEQ ID NO: 89;

o) a gRNA comprising a CRISPR repeat sequence having at least 90% sequence identity to SEQ ID NO: 97 and a tracrRNA having at least 90% sequence identity to SEQ ID NO: 98, wherein said RGN polypeptide has an amino acid sequence having at least 90% sequence identity to SEQ ID NO: 96;

p) a gRNA comprising a CRISPR repeat sequence having at least 90% sequence identity to SEQ ID NO: 104 and a tracrRNA having at least 90% sequence identity to SEQ ID NO: 105, wherein said RGN polypeptide has an amino acid sequence having at least 90% sequence identity to SEQ ID NO: 103;

q) a gRNA comprising a CRISPR repeat sequence having at least 90% sequence identity to SEQ ID NO: 111 and a tracrRNA having at least 90% sequence identity to SEQ ID NO: 112, wherein said RGN polypeptide has an amino acid sequence having at least 90% sequence identity to SEQ ID NO: 110;

r) a gRNA comprising a CRISPR repeat sequence having at least 90% sequence identity to SEQ ID NO: 118 and a tracrRNA having at least 90% sequence identity to SEQ ID NO: 119, wherein said RGN polypeptide has an amino acid sequence having at least 90% sequence identity to SEQ ID NO: 117;

s) a gRNA comprising a CRISPR repeat sequence having at least 90% sequence identity to SEQ ID NO: 124 and a tracrRNA having at least 90% sequence identity to SEQ ID NO: 125, wherein said RGN polypeptide has an amino acid sequence having at least 90% sequence identity to SEQ ID NO: 123; and t) a gRNA comprising a CRISPR repeat sequence having at least 90% sequence identity to SEQ ID NO: 84 and a tracrRNA having at least 90% sequence identity to SEQ ID NO: 78, wherein said RGN polypeptide has an amino acid sequence having at least 90% sequence identity to SEQ ID NO: 83.

185. The method of embodiment 180, wherein said gRNA is selected from the group consisting of:

a) a gRNA comprising a CRISPR repeat sequence having at least 95% sequence identity to SEQ ID NO: 2 and a tracrRNA having at least 95% sequence identity to SEQ ID NO: 3, wherein said RGN polypeptide has an amino acid sequence having at least 95% sequence identity to SEQ ID NO: 1;

b) a gRNA comprising a CRISPR repeat sequence having at least 95% sequence identity to SEQ ID NO: 9 and a tracrRNA having at least 95% sequence identity to SEQ ID NO: 10, wherein said RGN polypeptide has an amino acid sequence having at least 95% sequence identity to SEQ ID NO: 8;

c) a gRNA comprising a CRISPR repeat sequence having at least 95% sequence identity to SEQ ID NO: 16 and a tracrRNA having at least 95% sequence identity to SEQ ID NO: 17, wherein said RGN polypeptide has an amino acid sequence having at least 95% sequence identity to SEQ ID NO: 15;

d) a gRNA comprising a CRISPR repeat sequence having at least 95% sequence identity to SEQ ID NO: 23 and a tracrRNA having at least 95% sequence identity to SEQ ID NO: 24, wherein said RGN polypeptide has an amino acid sequence having at least 95% sequence identity to SEQ ID NO: 22;

e) a gRNA comprising a CRISPR repeat sequence having at least 95% sequence identity to SEQ ID NO: 30 and a tracrRNA having at least 95% sequence identity to SEQ ID NO: 31, wherein said RGN polypeptide has an amino acid sequence having at least 95% sequence identity to SEQ ID NO: 29;

f) a gRNA comprising a CRISPR repeat sequence having at least 95% sequence identity to SEQ ID NO: 37 and a tracrRNA having at least 95% sequence identity to SEQ ID NO: 38, wherein said RGN polypeptide has an amino acid sequence having at least 95% sequence identity to SEQ ID NO: 36;

g) a gRNA comprising a CRISPR repeat sequence having at least 95% sequence identity to SEQ ID NO: 44 and a tracrRNA having at least 95% sequence identity to SEQ ID NO: 45, wherein said RGN polypeptide has an amino acid sequence having at least 95% sequence identity to SEQ ID NO: 43;

h) a gRNA comprising a CRISPR repeat sequence having at least 95% sequence identity to SEQ ID NO: 51 and a tracrRNA having at least 95% sequence identity to SEQ ID NO: 52, wherein said RGN polypeptide has an amino acid sequence having at least 95% sequence identity to SEQ ID NO: 50;

i) a gRNA comprising a CRISPR repeat sequence having at least 95% sequence identity to SEQ ID NO: 57 and a tracrRNA having at least 95% sequence identity to SEQ ID NO: 58, wherein said RGN polypeptide has an amino acid sequence having at least 95% sequence identity to SEQ ID NO: 56;

j) a gRNA comprising a CRISPR repeat sequence having at least 95% sequence identity to SEQ ID NO: 64 and a tracrRNA having at least 95% sequence identity to SEQ ID NO: 65, wherein said RGN polypeptide has an amino acid sequence having at least 95% sequence identity to any one of SEQ ID NOs: 63 and 570-579;

k) a gRNA comprising a CRISPR repeat sequence having at least 95% sequence identity to SEQ ID NO: 71 and a tracrRNA having at least 95% sequence identity to SEQ ID NO: 72, wherein said RGN polypeptide has an amino acid sequence having at least 95% sequence identity to SEQ ID NO: 70;

l) a gRNA comprising a CRISPR repeat sequence having at least 95% sequence identity to SEQ ID NO: 77 and a tracrRNA having at least 95% sequence identity to SEQ ID NO: 78, wherein said RGN polypeptide has an amino acid sequence having at least 95% sequence identity to SEQ ID NO: 76;
m) a gRNA comprising a CRISPR repeat sequence having at least 95% sequence identity to SEQ ID NO: 84 and a tracrRNA having at least 95% sequence identity to SEQ ID NO: 85, wherein said RGN polypeptide has an amino acid sequence having at least 95% sequence identity to SEQ ID NO: 83;
n) a gRNA comprising a CRISPR repeat sequence having at least 95% sequence identity to SEQ ID NO: 90 and a tracrRNA having at least 95% sequence identity to SEQ ID NO: 91, wherein said RGN polypeptide has an amino acid sequence having at least 95% sequence identity to SEQ ID NO: 89;
o) a gRNA comprising a CRISPR repeat sequence having at least 95% sequence identity to SEQ ID NO: 97 and a tracrRNA having at least 95% sequence identity to SEQ ID NO: 98, wherein said RGN polypeptide has an amino acid sequence having at least 95% sequence identity to SEQ ID NO: 96;
p) a gRNA comprising a CRISPR repeat sequence having at least 95% sequence identity to SEQ ID NO: 104 and a tracrRNA having at least 95% sequence identity to SEQ ID NO: 105, wherein said RGN polypeptide has an amino acid sequence having at least 95% sequence identity to SEQ ID NO: 103;
q) a gRNA comprising a CRISPR repeat sequence having at least 95% sequence identity to SEQ ID NO: 111 and a tracrRNA having at least 95% sequence identity to SEQ ID NO: 112, wherein said RGN polypeptide has an amino acid sequence having at least 95% sequence identity to SEQ ID NO: 110;
r) a gRNA comprising a CRISPR repeat sequence having at least 95% sequence identity to SEQ ID NO: 118 and a tracrRNA having at least 95% sequence identity to SEQ ID NO: 119, wherein said RGN polypeptide has an amino acid sequence having at least 95% sequence identity to SEQ ID NO: 117;
s) a gRNA comprising a CRISPR repeat sequence having at least 95% sequence identity to SEQ ID NO: 124 and a tracrRNA having at least 95% sequence identity to SEQ ID NO: 125, wherein NO: 123; and
t) a gRNA comprising a CRISPR repeat sequence having at least 95% sequence identity to SEQ ID NO: 84 and a tracrRNA having at least 95% sequence identity to SEQ ID NO: 78, wherein said RGN polypeptide has an amino acid sequence having at least 95% sequence identity to SEQ ID NO: 83.

186. The method of embodiment 180, wherein said gRNA is selected from the group consisting of:
a) a gRNA comprising a CRISPR repeat sequence having 100% sequence identity to SEQ ID NO: 2 and a tracrRNA having 100% sequence identity to SEQ ID NO: 3, wherein said RGN polypeptide has an amino acid sequence having 100% sequence identity to SEQ ID NO: 1;
b) a gRNA comprising a CRISPR repeat sequence having 100% sequence identity to SEQ ID NO: 9 and a tracrRNA having 100% sequence identity to SEQ ID NO: 10, wherein said RGN polypeptide has an amino acid sequence having 100% sequence identity to SEQ ID NO: 8;
c) a gRNA comprising a CRISPR repeat sequence having 100% sequence identity to SEQ ID NO: 16 and a tracrRNA having 100% sequence identity to SEQ ID NO: 17, wherein said RGN polypeptide has an amino acid sequence having 100% sequence identity to SEQ ID NO: 15;
d) a gRNA comprising a CRISPR repeat sequence having 100% sequence identity to SEQ ID NO: 23 and a tracrRNA having 100% sequence identity to SEQ ID NO: 24, wherein said RGN polypeptide has an amino acid sequence having 100% sequence identity to SEQ ID NO: 22;
e) a gRNA comprising a CRISPR repeat sequence having 100% sequence identity to SEQ ID NO: 30 and a tracrRNA having 100% sequence identity to SEQ ID NO: 31, wherein said RGN polypeptide has an amino acid sequence having 100% sequence identity to SEQ ID NO: 29;
f) a gRNA comprising a CRISPR repeat sequence having 100% sequence identity to SEQ ID NO: 37 and a tracrRNA having 100% sequence identity to SEQ ID NO: 38, wherein said RGN polypeptide has an amino acid sequence having 100% sequence identity to SEQ ID NO: 36;
g) a gRNA comprising a CRISPR repeat sequence having 100% sequence identity to SEQ ID NO: 44 and a tracrRNA having 100% sequence identity to SEQ ID NO: 45, wherein said RGN polypeptide has an amino acid sequence having 100% sequence identity to SEQ ID NO: 43;
h) a gRNA comprising a CRISPR repeat sequence having 100% sequence identity to SEQ ID NO: 51 and a tracrRNA having 100% sequence identity to SEQ ID NO: 52, wherein said RGN polypeptide has an amino acid sequence having 100% sequence identity to SEQ ID NO: 50;
i) a gRNA comprising a CRISPR repeat sequence having 100% sequence identity to SEQ ID NO: 57 and a tracrRNA having 100% sequence identity to SEQ ID NO: 58, wherein said RGN polypeptide has an amino acid sequence having 100% sequence identity to SEQ ID NO: 56;
j) a gRNA comprising a CRISPR repeat sequence having 100% sequence identity to SEQ ID NO: 64 and a tracrRNA having 100% sequence identity to SEQ ID NO: 65, wherein said RGN polypeptide has an amino acid sequence having 100% sequence identity to any one of SEQ ID NOs: 63 and 570-579;
k) a gRNA comprising a CRISPR repeat sequence having 100% sequence identity to SEQ ID NO: 71 and a tracrRNA having 100% sequence identity to SEQ ID NO: 72, wherein said RGN polypeptide has an amino acid sequence having 100% sequence identity to SEQ ID NO: 70;
l) a gRNA comprising a CRISPR repeat sequence having 100% sequence identity to SEQ ID NO: 77 and a tracrRNA having 100% sequence identity to SEQ ID NO: 78, wherein said RGN polypeptide has an amino acid sequence having 100% sequence identity to SEQ ID NO: 76;
m) a gRNA comprising a CRISPR repeat sequence having 100% sequence identity to SEQ ID NO: 84 and a tracrRNA having 100% sequence identity to SEQ ID NO: 85, wherein said RGN polypeptide has an amino acid sequence having 100% sequence identity to SEQ ID NO: 83;
n) a gRNA comprising a CRISPR repeat sequence having 100% sequence identity to SEQ ID NO: 90 and a tracrRNA having 100% sequence identity to SEQ ID NO: 91, wherein said RGN polypeptide has an amino acid sequence having 100% sequence identity to SEQ ID NO: 89;

o) a gRNA comprising a CRISPR repeat sequence having 100% sequence identity to SEQ ID NO: 97 and a tracrRNA having 100% sequence identity to SEQ ID NO: 98, wherein said RGN polypeptide has an amino acid sequence having 100% sequence identity to SEQ ID NO: 96;

p) a gRNA comprising a CRISPR repeat sequence having 100% sequence identity to SEQ ID NO: 104 and a tracrRNA having 100% sequence identity to SEQ ID NO: 105, wherein said RGN polypeptide has an amino acid sequence having 100% sequence identity to SEQ ID NO: 103;

q) a gRNA comprising a CRISPR repeat sequence having 100% sequence identity to SEQ ID NO: 111 and a tracrRNA having 100% sequence identity to SEQ ID NO: 112, wherein said RGN polypeptide has an amino acid sequence having 100% sequence identity to SEQ ID NO: 110;

r) a gRNA comprising a CRISPR repeat sequence having 100% sequence identity to SEQ ID NO: 118 and a tracrRNA having 100% sequence identity to SEQ ID NO: 119, wherein said RGN polypeptide has an amino acid sequence having 100% sequence identity to SEQ ID NO: 117;

s) a gRNA comprising a CRISPR repeat sequence having 100% sequence identity to SEQ ID NO: 124 and a tracrRNA having 100% sequence identity to SEQ ID NO: 125, wherein said RGN polypeptide has an amino acid sequence having 100% sequence identity to SEQ ID NO: 123; and t) a gRNA comprising a CRISPR repeat sequence having 100% sequence identity to SEQ ID NO: 84 and a tracrRNA having 100% sequence identity to SEQ ID NO: 78, wherein said RGN polypeptide has an amino acid sequence having 100% sequence identity to SEQ ID NO: 83.

187. The method of any one of embodiments 180-186, wherein the gRNA further comprises a spacer sequence that targets a region within or proximal to the BCL11A enhancer region.

188. A method of treating a disease, said method comprising administering to a subject in need thereof an effective amount of a pharmaceutical composition of embodiment 106 or 159.

189. The method of embodiment 188, wherein said disease is associated with a causal mutation and said effective amount of said pharmaceutical composition corrects said causal mutation.

190. Use of the nucleic acid molecule of any one of embodiments 1-14, 43-45, and 57-59, the vector of any one of embodiments 15-21, 46-56, and 60-70, the cell of any one of embodiments 22, 147, 148, and 152-156, the isolated RGN polypeptide of any one of embodiments 31-42, or the system of any one of embodiments 71-105 for the treatment of a disease in a subject.

191. The use of embodiment 190, wherein said disease is associated with a causal mutation and said treating comprises correcting said causal mutation.

192. Use of the nucleic acid molecule of any one of embodiments 1-14, 43-45, and 57-59, the vector of any one of embodiments 15-21, 46-56, and 60-70, the cell of any one of embodiments 22, 147, 148, and 152-156, the isolated RGN polypeptide of any one of embodiments 31-42, or the system of any one of embodiments 71-105 for the manufacture of a medicament useful for treating a disease.

193. The use of embodiment 192, wherein said disease is associated with a causal mutation and an effective amount of said medicament corrects said causal mutation.

The following examples are offered by way of illustration and not by way of limitation.

EXAMPLES

Example 1. Identification of RNA-Guided Nuclease

Nineteen distinct CRISPR-associated RNA-guided nucleases (RGNs) were identified and are described in Table 1 below. Table 1 provides the name of each RGN, its amino acid sequence, the source from which it was derived, and processed crRNA and tracrRNA sequences (see Example 2 for methods of identification). Table 1 further provides a generic single guide RNA (sgRNA) sequence, where the poly-N indicates the location of the spacer sequence which determines the nucleic acid target sequence of the sgRNA. For RGN systems APG06622, APG02787, and APG06248, the conserved sequence in the base of the hairpin stem of the tracrRNA is UNANNA (SEQ ID NO: 129). For APG06007, APG09344, and APG07991, the sequence in the same location is UNANNU (SEQ ID NO: 130). For APG02874, APG03850, and APG07553, the sequence in the same location is UNANNG (SEQ ID NO: 131). For RGN systems APG03031, APG09208, APG05586, APG08770, APG03021, APG06015, APG01868, and APG02998, the conserved sequence in the base of the hairpin stem of the tracrRNA is UNANNC (SEQ ID NO: 132). For APG08167 and APG01604, the sequence in the same location is CNANNC (SEQ ID NO: 133).

TABLE 1

Summary of SEQ IDs and CRISPR associated systems

| RGN ID | SEQ ID NO. | Source | crRNA repeat seq (SEQ ID NO.) | tracrRNA (SEQ ID NO.) | sgRNA backbone (SEQ ID NO) |
|---|---|---|---|---|---|
| APG06622 | 1 | *Pedobacter* sp. | 2 | 3 | 4 |
| APG02787 | 8 | *Chitinophaga* sp. | 9 | 10 | 11 |
| APG06248 | 15 | *Mucilaginibacter* sp. | 16 | 17 | 18 |
| APG06007 | 22 | *Acidovorax* sp. | 23 | 24 | 25 |
| APG02874 | 29 | *Bacillus* sp. | 30 | 31 | 32 |
| APG03850 | 36 | *Bacillus* sp. | 37 | 38 | 39 |
| APG07553 | 43 | *Bacillus* sp. | 44 | 45 | 46 |
| APG03031 | 50 | *Chryseobacterium* sp. | 51 | 52 | 53 |
| APG09208 | 56 | *Bacillus* sp. | 57 | 58 | 59 |
| APG05586 | 63 | *Enterococcus* sp. | 64 | 65 | 66 |
| APG08770 | 70 | *Enterococcus* sp. | 71 | 72 | 73 |
| APG08167 | 76 | *Staphylococcus* sp. | 77 | 78 | 79 |
| APG01604 | 83 | *Staphylococcus* sp. | 84 | 85 | 86 |
| APG03021 | 89 | *Streptococcus* sp. | 90 | 91 | 92 |
| APG06015 | 96 | *Pediococcus* sp. | 97 | 98 | 99 |
| APG09344 | 103 | *Weissella* sp. | 104 | 105 | 106 |
| APG07991 | 110 | *Enterococcus* sp. | 111 | 112 | 113 |
| APG01868 | 117 | *Enterococcus* sp. | 118 | 119 | 120 |
| APG02998 | 123 | *Enterococcus* sp. | 124 | 125 | 126 |

Example 2: Guide RNA Identification and sgRNA Construction

Cultures of bacteria that natively express the RNA-guided nuclease system under investigation were grown to mid-log phase (OD600 of ~0.600), pelleted, and flash frozen. RNA was isolated from the pellets using a mirVANA miRNA Isolation Kit (Life Technologies, Carlsbad, CA), and sequencing libraries were prepared from the isolated RNA using an NEBNext Small RNA Library Prep kit (NEB, Beverly, MA). The library prep was fractionated on a 6% polyacrylamide gel to capture the RNA species less than 200 nt to detect crRNAs and tracrRNAs, respectively. Deep sequencing (75 bp paired-end) was performed on a Next Seq 500 (High Output kit) by a service provider (MoGene, St. Louis, MO). Reads were quality trimmed using Cutadapt and mapped to reference genomes using Bowtie2. A custom RNAseq pipeline was written in python to detect the crRNA and tracrRNA transcripts. Processed crRNA boundaries were determined by sequence coverage of the native repeat spacer array. The anti-repeat portion of the tracrRNA was identified using permissive BLASTn parameters. RNA sequencing depth confirmed the boundaries of the processed tracrRNA by identifying the transcript containing the anti-repeat. Manual curation of RNAs was performed using secondary structure prediction by NUPACK, an RNA folding software. sgRNA cassettes were prepared by DNA synthesis and were generally designed as follows (5'→3'): 20-30 bp spacer sequence, operably linked at its 3' end to the processed repeat portion of the crRNA, operably linked to a 4 bp noncomplementary linker (AAAG; SEQ ID NO: 249), operably linked at its 3' end to the processed tracrRNA. Other 4 bp noncomplementary linkers may also be used.

For in vitro assays, sgRNAs were synthesized by in vitro transcription of the sgRNA cassettes with a GeneArt™ Precision gRNA Synthesis Kit (ThermoFisher). Processed crRNA and tracrRNA sequences for each of the RGN polypeptides are identified and are set forth in Table 1. See below for the sgRNAs constructed for PAM libraries 1 and 2.

Example 3: Determination of PAM Requirements for Each RGN

PAM requirements for each RGN were determined using a PAM depletion assay essentially adapted from Kleinstiver et al. (2015) *Nature* 523:481-485 and Zetsche et al. (2015) *Cell* 163:759-771. Briefly, two plasmid libraries (L1 and L2) were generated in a pUC18 backbone (ampR), with each containing a distinct 30 bp protospacer (target) sequence flanked by 8 random nucleotides (i.e., the PAM region). The target sequence and flanking PAM region of library 1 and library 2 for each RGN are set forth in Table 2.

The libraries were separately electroporated into *E. coli* BL21(DE3) cells harboring pRSF-1b expression vectors containing an RGN of the invention (codon optimized for *E. coli*) along with a cognate sgRNA containing a spacer sequence corresponding to the protospacer in L1 or L2. Sufficient library plasmid was used in the transformation reaction to obtain >10⁶ CFU. Both the RGN and sgRNA in the pRSF-1b backbone were under the control of T7 promoters. The transformation reaction was allowed to recover for 1 hr after which it was diluted into LB media containing carbenicillin and kanamycin and grown overnight. The following day, the mixture was diluted into self-inducing Overnight Express™ Instant TB Medium (Millipore Sigma) to allow expression of the RGN and sgRNA, and grown for an additional 4 h or 20 h after which the cells were spun down and plasmid DNA was isolated with a Mini-prep kit (Qiagen, Germantown, MD). In the presence of the appropriate sgRNA, plasmids containing a PAM that is recognizable by the RGN will be cleaved resulting in their removal from the population. Plasmids containing PAMs that are not recognizable by the RGN, or that are transformed into bacteria not containing an appropriate sgRNA, will survive and replicate. The PAM and protospacer regions of uncleaved plasmids were PCR-amplified and prepared for sequencing following published protocols (16s-metagenomic library prep guide 15044223B, Illumina, San Diego, CA). Deep sequencing (75 bp single end reads) was performed on a MiSeq (Illumina) by a service provider (MoGene, St. Louis, MO). Typically, 1-4M reads were obtained per amplicon. PAM regions were extracted, counted, and normalized to total reads for each sample. PAMs that lead to plasmid cleavage were identified by being underrepresented when compared to controls (i.e., when the library is transformed into *E. coli* containing the RGN but lacking an appropriate sgRNA). To represent PAM requirements for a novel RGN, the depletion ratios (frequency in sample/frequency in control) for all sequences in the region in question were converted to enrichment values with a –log base 2 transformation. Sufficient PAMs were defined as those with enrichment values >2.3 (which corresponds to depletion ratios <~0.2). PAMs above this threshold in both libraries were collected and used to generate web logos, which for example can be generated using a web-based service on the internet known as "weblogo". PAM sequences were identified and reported when there was a consistent pattern in the top enriched PAMs. A consensus PAM (having an enrichment factor (EF)>2.3) for each RGN is provided in Table 2. The PAM orientation is also indicated in Table 2.

TABLE 2

PAM or PAM-like determination

| RGN ID | sgRNA L1 (SEQ ID NO.) | sgRNA L2 (SEQ ID NO.) | PAM (SEQ ID NO.) | PAM orientation |
|---|---|---|---|---|
| APG06622 | 5 | 6 | 7 | 5'-target-PAM-3' |
| APG02787 | 12 | 13 | 14 | 5'-target-PAM-3' |
| APG06248 | 19 | 20 | 21 | 5'-target-PAM-3' |
| APG06007 | 26 | 27 | 28 | 5'-target-PAM-3' |
| APG02874 | 33 | 34 | 35 | 5'-target-PAM-3' |
| APG03850 | 40 | 41 | 42 | 5'-target-PAM-3' |
| APG07553 | 47 | 48 | 49 | 5'-target-PAM-3' |
| APG03031 | 54 | 55 | 35 | 5'-target-PAM-3' |
| APG09208 | 60 | 61 | 62 | 5'-target-PAM-3' |
| APG05586 | 67 | 68 | 69 | 5'-target-PAM-3' |
| APG08770 | 74 | 75 | 69 | 5'-target-PAM-3' |
| APG08167 | 80 | 81 | 82 | 5'-target-PAM-3' |
| APG01604 | 87 | 88 | 82 | 5'-target-PAM-3' |
| APG03021 | 93 | 94 | 95 | 5'-target-PAM-3' |
| APG06015 | 100 | 101 | 102 | 5'-target-PAM-3' |
| APG09344 | 107 | 108 | 109 | 5'-target-PAM-3' |
| APG07991 | 114 | 115 | 116 | 5'-target-PAM-3' |
| APG01868 | 121 | 122 | 116 | 5'-target-PAM-3' |
| APG02998 | 127 | 128 | 116 | 5'-target-PAM-3' |

Example 4: Demonstration of Gene Editing Activity in Mammalian Cells

RGN expression cassettes were produced and introduced into vectors for mammalian expression. Each RGN was codon-optimized for human expression (SEQ ID NOs: 134-152), and operably fused at the 5' end to an SV40 nuclear localization sequence (NLS; SEQ ID NO: 251) and to 3×FLAG tags (SEQ ID NO: 252), and operably fused at the 3' end to nucleoplasmin NLS sequences (SEQ ID NO: 253). Two copies of the NLS sequence were used, operably fused in tandem. Each expression cassette was under control of a cytomegalovirus (CMV) promoter (SEQ ID NO: 258). It is known in the art that the CMB transcription enhancer (SEQ ID NO: 259) may also be included in constructs comprising the CMV promoter. Guide RNA expression constructs encoding a single gRNA each under the control of a human RNA polymerase III U6 promoter (SEQ ID NO: 260) were produced and introduced into the pTwist High Copy Amp vector. Sequences for the target sequences for each guide are in Table 3.

Several of the constructs described above were introduced into mammalian cells. One day prior to transfection, 1×10⁵ HEK293T cells (Sigma) were plated in 24-well dishes in Dulbecco's modified Eagle medium (DMEM) plus 10% (vol/vol) fetal bovine serum (Gibco) and 1% Penicillin-Streptomycin (Gibco). The next day when the cells were at 50-60% confluency, 500 ng of an RGN expression plasmid plus 500 ng of a single gRNA expression plasmid were co-transfected using 1.5 µL of Lipofectamine 3000 (Thermo Scientific) per well, following the manufacturer's instructions. After 48 hours of growth, total genomic DNA was harvested using a genomic DNA isolation kit (Machery-Nagel) according to the manufacturer's instructions.

The total genomic DNA was then analyzed to determine the rate of editing for each RGN for each genomic target. First, oligonucleotides were produced to be used for PCR amplification and subsequent analysis of the amplified genomic target site. Oligonucleotide sequences used are listed in Table 4.

All PCR reactions were performed using 10 µL of 2× Master Mix Phusion High-Fidelity DNA polymerase (Thermo Scientific) in a 20 µL reaction including 0.5 µM of each primer. Large genomic regions encompassing each target gene were first amplified using PCR #1 primers, using a program of: 98° C., 1 min; 30 cycles of [98° C., 10 sec; 62° C., 15 sec; 72° C., 5 min]; 72° C., 5 min; 12° C., forever. One microliter of this PCR reaction was then further amplified using primers specific for each guide (PCR #2 primers), using a program of: 98° C., 1 min; 35 cycles of [98° C., 10 sec; 67° C., 15 sec; 72° C., 30 sec]; 72° C., 5 min; 12° C., forever. Primers for PCR #2 include Nextera Read 1 and Read 2 Transposase Adapter overhang sequences for Illumina sequencing.

For RGNs APG02874, APG03850, and APG09208, methods were carried out as described above. A number of different genes in the human genome were targeted for RNA-guided cleavage. These loci are included in Table 3 below, along with the reference to the SEQ ID NO of the sgRNA. The indel percentage, which is an indication of RGN activity, is also shown.

TABLE 3

Target and sgRNA sequences for guide RNAs used to test gene editing activity in mammalian cells

| RGN ID | Gene | Guide ID | Target Sequence (SEQ ID NO.) | sgRNA (SEQ ID NO.) |
|---|---|---|---|---|
| APG02874, APG09208 | RelA | SGN000973, SGN000778 | 153 | 188, 206 |
| APG02874 | RelA | SGN000974 | 154 | 189 |
| APG02874 | RelA | SGN000975, SGN000780 | 155 | 190, 208 |
| APG02874, APG09208 | AurkB | SGN000976, SGN000775 | 156 | 191, 204 |
| APG02874, APG09208 | AurkB | SGN000977, SGN000776 | 157 | 192, 205 |
| APG02874 | AurkB | SGN000978 | 158 | 193 |
| APG02874 | VEGFA | SGN000979 | 159 | 194 |
| APG02874 | VEGFA | SGN000981 | 160 | 195 |
| APG03850 | RelA | SGN000982 | 161 | 196 |
| APG03850 | RelA | SGN000983 | 162 | 197 |
| APG03850 | RelA | SGN000984 | 163 | 198 |
| APG03850 | AurkB | SGN000985 | 164 | 199 |
| APG03850 | AurkB | SGN000986 | 165 | 200 |
| APG03850 | AurkB | SGN000987 | 166 | 201 |
| APG03850 | VEGFA | SGN000988 | 167 | 202 |
| APG03850 | VEGFA | SGN000990 | 168 | 203 |
| APG09208 | RelA | SGN000779 | 169 | 207 |
| APG09208 | AurkB | SGN000793 | 170 | 209 |
| APG09208 | AurkB | SGN000794 | 171 | 210 |
| APG05586 | TRA | SGN001163 | 553 | 557 |
| APG05586 | TRA | SGN001164 | 554 | 558 |
| APG05586 | VEGFA | SGN001165 | 555 | 559 |
| APG05586 | VEGFA | SGN001166 | 556 | 560 |
| APG09208 | RelA | SGN000778 | 153 | 206 |
| APG09208 | AurkB | SGN000793 | 609 | 811 |
| APG05586, APG08770, APG09298 | EMX1 | SGN001159 | 610 | 812 |
| APG05586, APG08770, APG09298 | TRA | SGN001162 | 611 | 813 |
| APG05586, APG08770, APG09298 | TRA | SGN001163 | 612 | 814 |
| APG05586, APG08770, APG09298 | TRA | SGN001164 | 613 | 815 |
| APG05586, APG08770, APG09298 | VEGFA | SGN001165 | 614 | 816 |
| APG05586, APG08770, APG09298 | VEGFA | SGN001166 | 615 | 817 |

TABLE 3-continued

Target and sgRNA sequences for guide RNAs used to
test gene editing activity in mammalian cells

| RGN ID | Gene | Guide ID | Target Sequence (SEQ ID NO.) | sgRNA (SEQ ID NO.) |
|---|---|---|---|---|
| APG05586, APG09298 | VEGFA | SGN001167 | 616 | 818 |
| APG09208 | RelA | SGN001213 | 617 | 819 |
| APG08167, APG01604 | VEGFA | SGN001245 | 618 | 820 |
| APG08167, APG01604 | VEGFA | SGN001246 | 619 | 821 |
| APG08167, APG01604 | VEGFA | SGN001247 | 620 | 822 |
| APG08167, APG01604 | RelA | SGN001248 | 621 | 823 |
| APG08167, APG01604 | RelA | SGN001249 | 622 | 824 |
| APG08167, APG01604 | RelA | SGN001250 | 623 | 825 |
| APG08167, APG01604 | AurkB | SGN001251 | 624 | 826 |
| APG08167, APG01604 | AurkB | SGN001252 | 625 | 827 |
| APG08167, APG01604 | AurkB | SGN001253 | 626 | 828 |
| APG07991 | RelA | SGN001312 | 627 | 829 |
| APG07991 | RelA | SGN001313 | 628 | 830 |
| APG07991 | RelA | SGN001314 | 629 | 831 |
| APG01868 | RelA | SGN001315 | 630 | 832 |
| APG01868 | RelA | SGN001316 | 631 | 833 |
| APG01868 | RelA | SGN001317 | 632 | 834 |
| APG02998 | RelA | SGN001318 | 633 | 835 |
| APG02998 | RelA | SGN001319 | 634 | 836 |
| APG02998 | RelA | SGN001320 | 635 | 837 |
| APG09344 | RelA | SGN001321 | 636 | 838 |
| APG06015 | RelA | SGN001322 | 637 | 839 |
| APG03021 | RelA | SGN001323 | 638 | 840 |
| APG09344 | RelA | SGN001324 | 639 | 841 |
| APG06015 | RelA | SGN001325 | 640 | 842 |
| APG03021 | RelA | SGN001326 | 641 | 843 |
| APG06015 | RelA | SGN001327 | 642 | 844 |
| APG03021 | RelA | SGN001328 | 643 | 845 |
| APG09344 | RelA | SGN001329 | 644 | 846 |
| APG03021 | TRA | SGN001330 | 645 | 847 |
| APG03021 | TRA | SGN001331 | 646 | 848 |
| APG03021 | TRA | SGN001332 | 647 | 849 |
| APG06015 | TRA | SGN001333 | 648 | 850 |
| APG06015 | TRA | SGN001334 | 649 | 851 |
| APG06015 | TRA | SGN001335 | 650 | 852 |
| APG09344 | TRA | SGN001336 | 651 | 853 |
| APG09344 | TRA | SGN001337 | 652 | 854 |
| APG09344 | TRA | SGN001338 | 653 | 855 |
| APG07991 | TRA | SGN001339 | 654 | 856 |
| APG07991 | TRA | SGN001340 | 655 | 857 |
| APG07991 | TRA | SGN001341 | 656 | 858 |
| APG01868 | TRA | SGN001342 | 657 | 859 |
| APG01868 | TRA | SGN001343 | 658 | 860 |
| APG01868 | TRA | SGN001344 | 659 | 861 |
| APG01868 | TRA | SGN001692 | 660 | 862 |
| APG02998 | TRA | SGN001345 | 661 | 863 |
| APG02998 | TRA | SGN001346 | 662 | 864 |
| APG02998 | TRA | SGN001347 | 663 | 865 |
| APG03021 | HA01 | SGN001348 | 664 | 866 |
| APG03021 | HAO1 | SGN001349 | 665 | 867 |
| APG03021 | HAO1 | SGN001350 | 666 | 868 |
| APG06015 | HAO1 | SGN001351 | 667 | 869 |
| APG06015 | HAO1 | SGN001352 | 668 | 870 |
| APG06015 | HAO1 | SGN001353 | 669 | 871 |
| APG09344 | HAO1 | SGN001354 | 670 | 872 |
| APG09344 | HAO1 | SGN001355 | 671 | 873 |
| APG09344 | HAO1 | SGN001356 | 672 | 874 |
| APG07991 | HAO1 | SGN001357 | 673 | 875 |
| APG07991 | HAO1 | SGN001358 | 674 | 876 |
| APG07991 | HAO1 | SGN001359 | 675 | 877 |
| APG01868 | HAO1 | SGN001360 | 676 | 878 |
| APG01868 | HAO1 | SGN001361 | 677 | 879 |
| APG01868 | HAO1 | SGN001362 | 678 | 880 |
| APG02998 | HAO1 | SGN001363 | 679 | 881 |
| APG02998 | HAO1 | SGN001364 | 680 | 882 |
| APG02998 | HAO1 | SGN001365 | 681 | 883 |
| APG05586, APG09298 | TRA | SGN001371 | 682 | 884 |
| APG05586, APG09298 | TRA | SGN001372 | 683 | 885 |
| APG05586, APG09298 | TRA | SGN001373 | 684 | 886 |
| APG05586, APG09298 | TRA | SGN001374 | 685 | 887 |
| APG05586, APG09298 | TRA | SGN001375 | 686 | 888 |
| APG05586, APG09298 | TRA | SGN001376 | 687 | 889 |
| APG05586, APG09298 | TRA | SGN001377 | 688 | 890 |
| APG05586, APG09298 | TRA | SGN001378 | 689 | 891 |

TABLE 3-continued

Target and sgRNA sequences for guide RNAs used to
test gene editing activity in mammalian cells

| RGN ID | Gene | Guide ID | Target Sequence (SEQ ID NO.) | sgRNA (SEQ ID NO.) |
|---|---|---|---|---|
| APG05586, APG09298 | TRA | SGN001379 | 690 | 892 |
| APG05586, APG09298 | TRA | SGN001380 | 691 | 893 |
| APG05586, APG09298 | TRA | SGN001381 | 692 | 894 |
| APG05586, APG09298 | TRA | SGN001382 | 693 | 895 |
| APG05586, APG09298 | B2M | SGN001383 | 694 | 896 |
| APG05586, APG09298 | B2M | SGN001384 | 695 | 897 |
| APG05586, APG09298 | B2M | SGN001385 | 696 | 898 |
| APG05586, APG09298 | B2M | SGN001386 | 697 | 899 |
| APG05586, APG09298 | B2M | SGN001387 | 698 | 900 |
| APG05586, APG09298 | B2M | SGN001388 | 699 | 901 |
| APG05586, APG09298 | B2M | SGN001389 | 700 | 902 |
| APG05586, APG09298 | B2M | SGN001390 | 701 | 903 |
| APG05586, APG09298 | B2M | SGN001391 | 702 | 904 |
| APG05586, APG09298 | B2M | SGN001392 | 703 | 905 |
| APG05586, APG09298 | B2M | SGN001393 | 704 | 906 |
| APG05586, APG09298 | B2M | SGN001394 | 705 | 907 |
| APG05586, APG09298 | LDHA | SGN001395 | 706 | 908 |
| APG05586, APG09298 | LDHA | SGN001396 | 707 | 909 |
| APG05586, APG09298 | LDHA | SGN001397 | 708 | 910 |
| APG05586, APG09298 | LDHA | SGN001399 | 709 | 911 |
| APG05586, APG09298 | LDHA | SGN001400 | 710 | 912 |
| APG05586, APG09298 | LDHA | SGN001401 | 711 | 913 |
| APG05586, APG09298 | LDHA | SGN001402 | 712 | 914 |
| APG05586, APG09298 | LDHA | SGN001403 | 713 | 915 |
| APG05586, APG09298 | LDHA | SGN001404 | 714 | 916 |
| APG05586, APG09298 | LDHA | SGN001405 | 715 | 917 |
| APG05586, APG09298 | HAO1 | SGN001406 | 716 | 918 |
| APG05586, APG09298 | HAO1 | SGN001407 | 717 | 919 |
| APG05586, APG09298 | HAO1 | SGN001408 | 718 | 920 |
| APG05586, APG09298 | HAO1 | SGN001409 | 719 | 921 |
| APG05586, APG09298 | HAO1 | SGN001410 | 720 | 922 |
| APG05586, APG09298 | HAO1 | SGN001411 | 721 | 923 |
| APG05586, APG09298 | HAO1 | SGN001412 | 722 | 924 |
| APG05586, APG09298 | HAO1 | SGN001413 | 723 | 925 |
| APG05586, APG09298 | HAO1 | SGN001414 | 724 | 926 |
| APG05586, APG09298 | HAO1 | SGN001415 | 725 | 927 |
| APG05586, APG09298 | HAO1 | SGN001416 | 726 | 928 |
| APG01604 | B2M | SGN001592 | 727 | 929 |
| APG01604 | B2M | SGN001593 | 728 | 930 |
| APG01604 | B2M | SGN001594 | 729 | 931 |
| APG01604 | B2M | SGN001595 | 730 | 932 |
| APG01604 | B2M | SGN001596 | 731 | 933 |
| APG01604 | B2M | SGN001597 | 732 | 934 |
| APG01604 | B2M | SGN001598 | 733 | 935 |
| APG01604 | B2M | SGN001599 | 734 | 936 |
| APG01604 | B2M | SGN001600 | 735 | 937 |
| APG01604 | B2M | SGN001601 | 736 | 938 |
| APG01604 | B2M | SGN001602 | 737 | 939 |
| APG01604 | B2M | SGN001603 | 738 | 940 |
| APG01604 | HAO1 | SGN001616 | 739 | 941 |
| APG01604 | HAO1 | SGN001617 | 740 | 942 |
| APG01604 | HAO1 | SGN001618 | 741 | 943 |
| APG01604 | HAO1 | SGN001619 | 742 | 944 |
| APG01604 | HAO1 | SGN001620 | 743 | 945 |
| APG01604 | HAO1 | SGN001621 | 744 | 946 |
| APG01604 | HAO1 | SGN001622 | 745 | 947 |
| APG01604 | HAO1 | SGN001623 | 746 | 948 |
| APG01604 | HAO1 | SGN001624 | 747 | 949 |
| APG01604 | HAO1 | SGN001625 | 748 | 950 |
| APG01604 | HAO1 | SGN001626 | 749 | 951 |
| APG01604 | HAO1 | SGN001627 | 750 | 952 |
| APG01604 | LDHA | SGN001640 | 751 | 953 |
| APG01604 | LDHA | SGN001641 | 752 | 954 |
| APG01604 | LDHA | SGN001642 | 753 | 955 |
| APG01604 | LDHA | SGN001643 | 754 | 956 |
| APG01604 | LDHA | SGN001644 | 755 | 957 |
| APG01604 | LDHA | SGN001645 | 756 | 958 |
| APG01604 | LDHA | SGN001646 | 757 | 959 |
| APG01604 | LDHA | SGN001647 | 758 | 960 |
| APG01604 | LDHA | SGN001648 | 759 | 961 |
| APG01604 | LDHA | SGN001649 | 760 | 962 |
| APG01604 | LDHA | SGN001650 | 761 | 963 |
| APG01604 | LDHA | SGN001651 | 762 | 964 |
| APG01604 | TRA | SGN001664 | 763 | 965 |

TABLE 3-continued

Target and sgRNA sequences for guide RNAs used to
test gene editing activity in mammalian cells

| RGN ID | Gene | Guide ID | Target Sequence (SEQ ID NO.) | sgRNA (SEQ ID NO.) |
|---|---|---|---|---|
| APG01604 | TRA | SGN001665 | 764 | 966 |
| APG01604 | TRA | SGN001666 | 765 | 967 |
| APG01604 | TRA | SGN001667 | 766 | 968 |
| APG01604 | TRA | SGN001668 | 767 | 969 |
| APG01604 | TRA | SGN001669 | 768 | 970 |
| APG01604 | TRA | SGN001670 | 769 | 971 |
| APG01604 | TRA | SGN001671 | 770 | 972 |
| APG01604 | TRA | SGN001672 | 771 | 973 |
| APG01604 | TRA | SGN001673 | 772 | 974 |
| APG01604 | TRA | SGN001674 | 773 | 975 |
| APG01604 | TRA | SGN001675 | 774 | 976 |
| APG01868 | TRA | SGN001684 | 775 | 977 |
| APG01868 | TRA | SGN001685 | 776 | 978 |
| APG01868 | TRA | SGN001686 | 777 | 979 |
| APG01868 | TRA | SGN001687 | 778 | 980 |
| APG01868 | TRA | SGN001688 | 779 | 981 |
| APG01868 | TRA | SGN001689 | 780 | 982 |
| APG01868 | TRA | SGN001690 | 781 | 983 |
| APG01868 | TRA | SGN001691 | 782 | 984 |
| APG01868 | EMX1 | SGN001697 | 783 | 985 |
| APG01868 | EMX1 | SGN001698 | 784 | 986 |
| APG01868 | EMX1 | SGN001699 | 785 | 987 |
| APG01868 | EMX1 | SGN001700 | 786 | 988 |
| APG01868 | EMX1 | SGN001701 | 787 | 989 |
| APG01868 | EMX1 | SGN001702 | 788 | 990 |
| APG01868 | EMX1 | SGN001703 | 789 | 991 |
| APG01868 | EMX1 | SGN001704 | 1176 | 992 |
| APG01868 | EMX1 | SGN001705 | 1177 | 993 |
| APG01868 | EMX1 | SGN001706 | 1178 | 994 |
| APG01868 | EMX1 | SGN001707 | 1179 | 995 |
| APG01868 | EMX1 | SGN001708 | 1180 | 996 |
| APG01868 | EMX1 | SGN001709 | 1181 | 997 |
| APG01868 | EMX1 | SGN001710 | 1182 | 998 |
| APG01868 | EMX1 | SGN001711 | 1183 | 999 |
| APG01868 | HAO1 | SGN001713 | 1184 | 1000 |
| APG01868 | HAO1 | SGN001714 | 1185 | 1001 |
| APG01868 | HAO1 | SGN001715 | 790 | 1002 |
| APG01868 | HAO1 | SGN001716 | 791 | 1003 |
| APG01868 | HAO1 | SGN001717 | 792 | 1004 |
| APG01868 | HAO1 | SGN001718 | 793 | 1005 |
| APG01868 | HAO1 | SGN001719 | 794 | 1006 |
| APG01868 | HAO1 | SGN001721 | 795 | 1007 |
| APG01868 | HAO1 | SGN001722 | 796 | 1008 |
| APG01868 | HAO1 | SGN001723 | 797 | 1009 |
| APG01868 | HAO1 | SGN001724 | 798 | 1010 |
| APG01868 | LDHA | SGN001725 | 799 | 1011 |
| APG01868 | LDHA | SGN001726 | 800 | 1012 |
| APG01868 | LDHA | SGN001727 | 801 | 1013 |
| APG01868 | LDHA | SGN001728 | 802 | 1014 |
| APG01868 | LDHA | SGN001729 | 803 | 1015 |
| APG01868 | LDHA | SGN001730 | 804 | 1016 |
| APG01868 | LDHA | SGN001731 | 805 | 1017 |
| APG01868 | LDHA | SGN001732 | 806 | 1018 |
| APG01868 | LDHA | SGN001733 | 807 | 1019 |
| APG01868 | LDHA | SGN001734 | 808 | 1020 |
| APG01868 | LDHA | SGN001735 | 809 | 1021 |
| APG01868 | VEGLA | SGN001785 | 810 | 1022 |

TABLE 4

Oligonucleotides for detection of gene editing activity in mammalian cells

| Description | Primer Sequence | SEQ ID NO |
|---|---|---|
| SGN000977 FWD | CTTGTAGCTGGAGGTCCATC | 172 |
| SGN000977 REV | TGTTGGCAAATCTAGTCTCG | 173 |
| SGN000978 FWD | ACATTTGACGAGCAGCGAA | 174 |
| SGN000978 REV | GGCCCCTGGAGAGGTTTTAA | 175 |
| SGN000979, SGN000982, SGN000988, SGN000990 FWD | ACACAGCTTCCCGTTCTCAG | 176 |

TABLE 4-continued

Oligonucleotides for detection of gene editing activity in mammalian cells

| Description | Primer Sequence | SEQ ID NO |
|---|---|---|
| SGN000979, SGN000982, SGN000988, SGN000990 REV | ATTCACCCAGCTTCCCTGTG | 177 |
| SGN000981 FWD | GGCGTCGCACTGAAACTTTT | 178 |
| SGN000981 REV | AGTTCATGGTTTCGGAGGCC | 179 |
| SGN000983 FWD | CGACCAAACAAGTGCAAAGG | 180 |
| SGN000983 REV | GGGTTGTTGTTGGTCTGGAT | 181 |
| SGN000775, SGN000776, SGN000793, SGN000794, SGN000976, SGN000985, SGN000986, SGN000987 FWD | ACTGCCATGGGAAGAAGGTG | 182 |
| SGN000775, SGN000776, SGN000793, SGN000794, SGN000976, SGN000985, SGN000986, SGN000987 REV | ACAATTCTCCTGCCTCAGCC | 183 |
| SGN000778, SGN000973, SGN000984 FWD | TGGCCCCTATGTGGAGATCA | 184 |
| SGN000778, SGN000973, SGN000984 REV | GGCAGAGCTCAGCCTCATAG | 185 |
| SGN000779, SGN000780, SGN000974, SGN000975 FWD | ATATCCCCACTTCCCCTGCT | 186 |
| SGN000779, SGN000780, SGN000974, SGN000975 REV | CACCTCAAGGACAGCTCTGG | 187 |
| SGN001163, SGN001164 FWD | TTGATAGCTTGTGCCTGTCC | 561 |
| SGN01163, SGN001164REV | AGAGTCTCTCAGCTGGTACA | 562 |
| SGN001165, SGN001166 FWD | GCGACAGGGGCAAAGTGAGT | 563 |
| SGN001165, SGN001166REV | CTAGCACTTCTCGCGGCTCC | 564 |
| SGN001382 FWD | AACTCATGCCTGCTGCTCTT | 1023 |
| SGN001382 REV | CAGTCTCACGCAGTCACTCA | 1024 |
| SGN001371, SGN001372, SGN001373, SGN001689, SGN001690 FWD | AACTGAGGCGGCTGAAATGA | 1025 |
| SGN001371, SGN001372, SGN001373, SGN001689, SGN001690 REV | TGGGACATGCAAGCCCATAA | 1026 |
| SGN001730 FWD | AAGATGTTGACATGCTCTTCC | 1027 |
| SGN001730 REV | TATGCAGTCAAAAGCCTCA | 1028 |
| SGN001353, SGN001356, SGN001359, SGN001362, SGN001365, SGN001406, SGN001407, SGN001412, SGN001413, SGN001414, SGN001622, SGN001623, SGN001624, SGN001625, SGN001626, SGN001627 FWD | AAGTCATTTGCTTGTTTGGA | 1029 |
| SGN001353, SGN001356, SGN001359, SGN001362, SGN001365, SGN001406, SGN001407, SGN001412, SGN001413, SGN001414, SGN001622, SGN001623, SGN001624, SGN001625, SGN001626, SGN001627 REV | TGGTGCATTCAGAGAAGGAG | 1030 |
| SGN001375, SGN001376, SGN001377 FWD | AATGAAGCCAGGCAAGAGCA | 1031 |
| SGN001375, SGN001376, SGN001377 REV | CTGTGCAAACCCAGGCTAGA | 1032 |
| SGN001251, SGN001252 FWD | ACATTTGACGAGCAGCGAA | 1033 |
| SGN001251, SGN001252 REV | GGCCCTGGAGAGGTTTTAA | 1034 |
| SGN001380 FWD | ACCCGGCCTGCTTTTCTTAA | 1035 |
| SGN001380 REV | GGCAGCGAGGCATACATAGT | 1036 |
| SGN001731, SGN001732, SGN001733, SGN001734, SGN001735 FWD | ACCCTGCTTTTTCTGCCTTT | 1037 |
| SGN001731, SGN001732, SGN001733, SGN001734, SGN001735 REV | CAGGCCTAATGGACATTAATCCT | 1038 |
| SGN001374, SGN001688 FWD | ACTCACTAAGGGGCCCATCT | 1039 |
| SGN001374, SGN001688 REV | CAGGAGGAGGATTCGGAACC | 1040 |
| SGN001726, SGN001727, SGN001728, SGN001729 FWD | AGGAAAATGAATCACAATTACT | 1041 |
| SGN001726, SGN001727, SGN001728, SGN001729 REV | GTGCGAAAGGGCAAGATTCT | 1042 |
| SGN001397 FWD | AGGCCTTTCAACTCTCTTTTGGCA | 1043 |
| SGN001397 REV | GGATGGGGTCAAGGTATGGGC | 1044 |
| SGN001213, SGN001248, SGN001249, SGN001321, SGN001322, SGN001323 FWD | ATGACATTCAGGCCACAGTG | 1045 |
| SGN001213, SGN001248, SGN001249, SGN001321, SGN001322, SGN001323 REV | CTTCCTCCTATTCAGGCCCA | 1046 |
| SGN001725 FWD | CAGCTTTTGAAATGGGGTGC | 1047 |
| SGN001725 REV | CAACAAATGGAGACCATCTGGA | 1048 |
| SGN001381 FWD | CAGTATTCTAAGGACGCCAGAAA | 1049 |
| SGN001381 REV | GCACTTTGGGAGGCTGAA | 1050 |
| SGN001390, SGN001391, SGN001392, SGN001393, SGN001394, SGN001592, SGN001593, SGN001594, SGN001595, SGN001596, SGN001597, SGN001598, SGN001599, SGN001600, SGN001601, SGN001602, SGN001603 FWD | CGGGCATTCCTGAAGCTG | 1051 |

TABLE 4-continued

Oligonucleotides for detection of gene editing activity in mammalian cells

| Description | Primer Sequence | SEQ ID NO |
|---|---|---|
| SGN001390, SGN001391, SGN001392, SGN001393, SGN001394, SGN001592, SGN001593, SGN001594, SGN001595, SGN001596, SGN001597, SGN001598, SGN001599, SGN001600, SGN001601, SGN001602, SGN001603 REV | GTAGGCCAAAGGTCTCCCC | 1052 |
| SGN001383, SGN001384, SGN001385, SGN001386, SGN001387, SGN001388, SGN001389 FWD | CTTGACACCAAGTTAGCCCC | 1053 |
| SGN001383, SGN001384, SGN001385, SGN001386, SGN001387, SGN001388, SGN001389 REV | TCATACACAACTTTCAGCAGC | 1054 |
| SGN000793, SGN001253 FWD | CTTGTAGCTGGAGGTCCATC | 1055 |
| SGN000793, SGN001253 REV | TGTTGGCAAATCTAGTCTCG | 1056 |
| SGN001379 FWD | GAGCAGCTGAGTCAATGATAGT | 1057 |
| SGN001379 REV | GGAGAGATCTGGAGGGAACTTA | 1058 |
| SGN001165, SGN001166, SGN001245 FWD | GCAAAGTGAGTGACCTGCTT | 1059 |
| SGN001165, SGN001166, SGN001245 REV | GAGCTAGCACTTCTCGCG | 1060 |
| SGN001738 FWD | GCTGTTTGGGAGGTCAGAAA | 1061 |
| SGN001738 REV | GAATATTGAAGGGGGCAGGG | 1062 |
| SGN001167, SGN001246, SGN001247, SGN001785 FWD | GGACACTTCCCAAAGGACC | 1063 |
| SGNOO1167, SGN001246, SGN001247, SGN001785 REV | CACGTCCTCACTCTCGAAGA | 1064 |
| SGN001399, SGN001402, SGN001403, SGN001646, SGN001647, SGN001648, SGN001649, SGN001650, SGN001651 FWD | GGCCTTCACTCTTCACAGACCC | 1065 |
| SGN001399, SGN001402, SGN001403, SGN001646, SGN001647, SGN001648, SGN001649, SGN001650, SGN001651 REV | GGATGGGGTCAAGGTATGGGC | 1066 |
| SGN001162, SGN001163, SGN001164, SGN001330, SGN001331, SGN001332, SGN001333, SGN001334, SGN001335, SGN001336, SGN001337, SGN001338, SGN001339, SGN001340, SGN001341, SGN001342, SGN001343, SGN001344, SGN001345, SGN001346, SGN001347, SGN001664, SGN001665, SGN001666, SGN001667, SGN001668, SGN001669, SGN001670, SGN001671, SGN001672, SGN001673, SGN001674, SGN001675, SGN001684, SGN001685, SGN001686, SGN001687, SGN001691, SGN001692 FWD | GGGCAAAGAGGGAAATGAGA | 1067 |
| SGN001162, SGN001163, SGN001164, SGN001330, SGN001331, SGN001332, SGN001333, SGN001334, SGN001335, SGN001336, SGN001337, SGN001338, SGN001339, SGN001340, SGN001341, SGN001342, SGN001343, SGN001344, SGN001345, SGN001346, SGN001347, SGN001664, SGN001665, SGN001666, SGN001667, SGN001668, SGN001669, SGN001670, SGN001671, SGN001672, SGN001673, SGN001674, SGN001675, SGN001684, SGN001685, SGN001686, SGN001687, SGN001691, SGN001692 REV | GAACCTGGCCATTCCTGAAG | 1068 |
| SGN001714, SGN001722 FWD | GGTTTTTGGAGGTGGAGTTGA | 1069 |
| SGN001714, SGN001722 REV | CCCCCTAACCAAGTGAAAAGA | 1070 |
| SGN001716, SGN001717, SGN001721 FWD | TAGATAAATGAGCAGTGAACAGCC | 1071 |
| SGN001716, SGN001717, SGN001721 REV | TCCACAAAGGATCACAAAGTCA | 1072 |
| SGN001313, SGN001316, SGN001319 FWD | TGAGAGACAGTGGGACAGAC | 1073 |
| SGN001313, SGN001316, SGN001319 REV | AGTCCTAGAGGAGGCAGAAC | 1074 |
| SGN001702, SGN001703, SGN001707, SGN001709, SGN001710, SGN001711 FWD | TGAGTCCGAGCAGAAGAAGA | 1075 |
| SGN001702, SGN001703, SGN001707, SGN001709, SGN001710, SGN001711 REV | GGAGATTGGAGACACGGAGA | 1076 |
| SGN001723 FWD | TGGAGGTGGAGTTGAATAACA | 1077 |
| SGN001723 REV | CTTTCTCCCCCTAACCAAGTG | 1078 |
| SGN001395, SGN001396 FWD | TGGATCTCCAACATGGCAGCC | 1079 |
| SGN001395, SGN001396 REV | CGGAAGGCTAAGGAGGGAGGA | 1080 |
| SGN000778, SGN001250, SGN001312, SGN001314, SGN001315, SGN001317, SGN001318, SGN001320, SGN001324, SGN001325, SGN001326, SGN001327, SGN001328, SGN001329 FWD | TGGCCCCTATGTGGAGATCA | 1081 |
| SGN000778, SGN001250, SGN001312, SGN001314, SGN001315, SGN001317, SGN001318, SGN001320, SGN001324, SGN001325, SGN001326, SGN001327, SGN001328, SGN001329 REV | GGCAGAGCTCAGCCTCATAG | 1082 |

TABLE 4-continued

Oligonucleotides for detection of gene editing activity in mammalian cells

| Description | Primer Sequence | SEQ ID NO |
|---|---|---|
| SGN001159, SGN001697, SGN001698, SGN001699, SGNOO1700, SGN001701, SGN001704, SGN001705, SGN001706, SGN001708 FWD | TGTTAGACCCATGGGAGCAG | 1083 |
| SGN001159, SGN001697, SGN001698, SGN001699, SGN001700, SGN001701, SGN001704, SGN001705, SGN001706, SGN001708 REV | GTTGCCCACCCTAGTCATT | 1084 |
| SGN001400, SGN001401, SGN001404, SGN001405, SGN001640, SGN001641, SGN001642, SGN001643, SGN001644, SGN001645 FWD | TTCCACGCTAAGGTATGGGCC | 1085 |
| SGN001400, SGN001401, SGN001404, SGN001405, SGN001640, SGN001641, SGN001642, SGN001643, SGN001644, SGN001645 REV | GCCAACAGCACCAACCCCAA | 1086 |
| SGN001348, SGN001349, SGN001350, SGN001351, SGN001352, SGN001354, SGN001355, SGN001357, SGN001358, SGN001360, SGN001361, SGN001363, SGN001364, SGN001408, SGN001409, SGN001410, SGN001411, SGN001415, SGN001416, SGN001616, SGN001617, SGN001618, SGN001619, SGN001620, SGN001621, SGN001713, SGN001715, SGN001718, SGN001719, SGN001724 FWD | TTGCTCACTTGATGTAAGCAA | 1087 |
| SGN001348, SGN001349, SGN001350, SGN001351, SGN001352, SGN001354, SGN001355, SGN001357, SGN001358, SGN001360, SGN001361, SGN001363, SGN001364, SGN001408, SGN001409, SGN001410, SGN001411, SGN001415, SGN001416, SGN001616, SGN001617, SGN001618, SGN001619, SGN001620, SGN001621, SGN001713, SGN001715, SGN001718, SGN001719, SGN001724 REV | TTTTGGTACGGTCTTTGTGT | 1088 |

Purified genomic DNA was subjected to PCR #1 and PCR #2 as above. Following the second PCR amplification, DNA was cleaned using a PCR cleanup kit (Zymo) according to the manufacturer's instructions and eluted in water. 200-500 ng of purified PCR #2 product was combined with 2 µL of 10×NEB Buffer 2 and water in a 20 µL reaction and annealed to form heteroduplex DNA using a program of: 95° C., 5 min; 95-85° C., cooled at a rate of 2° C./sec; 85-25° C., cooled at a rate of 0.1° C./sec.; 12° C., forever. Following annealing 5 µL of DNA was removed as a no enzyme control, and 1 µL of T7 Endonuclease I (NEB) was added and the reaction incubated at 37° C. for 1 hr. After incubation 5× FlashGel loading dye (Lonza) was added and 5 µL of each reaction and controls were analyzed by a 2.2% agarose FlashGel (Lonza) using gel electrophoresis. Following visualization of the gel, the percentage of non-homologous end joining (NHEJ) was determined using the following equation: % NHEJ events=100×[1−(1−fraction cleaved)($\frac{1}{2}$)], where (fraction cleaved) is defined as: (density of digested products)/(density of digested products+undigested parental band).

For some samples, SURVEYOR® was used to analyze the results following expression in mammalian cells. Cells were incubated at 37° C. for 72 h post-transfection before genomic DNA extraction. Genomic DNA was extracted using the QuickExtract DNA Extraction Solution (Epicentre) following the manufacturer's protocol. The genomic region flanking the RGN target site was PCR amplified, and products were purified using QiaQuick Spin Column (Qiagen) following the manufacturer's protocol. 200-500 ng total of the purified PCR products were mixed with 1 µl 10× Taq DNA Polymerase PCR buffer (Enzymatics) and ultrapure water to a final volume of 10 µl, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 min.

After reannealing, products were treated with SURVEYOR® nuclease and SURVEYOR® enhancer S (Integrated DNA Technologies) following the manufacturer's recommended protocol and analyzed on 4-20% Novex TBE polyacrylamide gels (Life Technologies). Gels were stained with SYBR Gold DNA stain (Life Technologies) for 10 min and imaged with a Gel Doc gel imaging system (Bio-rad). Quantification was based on relative band intensities. Indel percentage was determined by the formula, 100×(1−(1−(b+c)/(a+b+c))$\frac{1}{2}$), where a is the integrated intensity of the undigested PCR product, and b and c are the integrated intensities of each cleavage product.

Additionally, products from PCR #2 containing Illumina overhang sequences underwent library preparation following the Illumina 16S Metagenomic Sequencing Library protocol. Deep sequencing was performed on an Illumina Mi-Seq platform by a service provider (MOGene). Typically, 200,000 of 250 bp paired-end reads (2×100,000 reads) are generated per amplicon. The reads were analyzed using CRISPResso (Pinello, et al. 2016 Nature Biotech, 34:695-697) to calculate the rates of editing. Output alignments were hand-curated to confirm insertion and deletion sites as well as identify microhomology sites at the recombination sites. The rates of editing are shown in Table 5. All experiments were performed in human cells. The "target sequence" is the targeted sequence within the gene target. For each target sequence, the guide RNA comprised the complementary RNA target sequence and the appropriate sgRNA depending on the RGN used. A selected breakdown of experiments by guide RNA is shown in Tables 6.1-6.3.

TABLE 5

Activity of RGNs in mammalian cells

| RGN | Guide ID | Gene target | Overall Editing Rate | Deletion Rate in Sample | Insertion Rate in Sample |
|---|---|---|---|---|---|
| APG02874 | SGN000973 | RelA | N.D. | | |
| APG02874 | SGN000974 | RelA | 0.10% | 37.23% | 62.77% |
| APG02874 | SGN000975 | RelA | N.D. | | |
| APG02874 | SGN000976 | AurkB | 0.56% | 35.17% | 64.84% |
| APG02874 | SGN000977 | AurkB | 0.30% | 76.34% | 23.65% |
| APG02874 | SGN000978 | AurkB | N.D. | | |
| APG02874 | SGN000979 | VEGFA | 0.17% | 13.95% | 86.05% |
| APG02874 | SGN000981 | VEGFA | N.D. | | |
| APG03850 | SGN000982 | RelA | 0.19% | 40.55% | 59.45% |
| APG03850 | SGN000983 | RelA | N.D. | | |
| APG03850 | SGN000984 | RelA | 0.05% | 72.17% | 27.84% |
| APG03850 | SGN000985 | AurkB | 0.37% | 66.62% | 33.37% |
| APG03850 | SGN000986 | AurkB | N.D. | | |
| APG03850 | SGN000987 | AurkB | N.D. | | |
| APG03850 | SGN000988 | VEGFA | N.D. | | |
| APG03850 | SGN000990 | VEGFA | N.D. | | |
| APG09208 | SGN000775 | AurkB | N.D. | | |
| APG09208 | SGN000776 | AurkB | N.D. | | |
| APG09208 | SGN000778 | RelA | N.D. | | |
| APG09208 | SGN000779 | RelA | N.D. | | |
| APG09208 | SGN000780 | RelA | N.D. | | |
| APG09208 | SGN000793 | AurkB | 1.18% | 59.97% | 40.02% |
| APG09208 | SGN000794 | AurkB | N.D. | | |
| APG05586 | SGN001163 | TRA | 23.49% | 95.03% | 5.41% |
| APG05586 | SGN001164 | TRA | 1.37% | 95.65% | 4.36% |
| APG05586 | SGN001165 | VEGFA | 65.59% | 98.58% | 2.03% |
| APG05586 | SGN001166 | VEGFA | 10.48% | 94.98% | 5.02% |
| APG06015 | SGN001322 | RelA | N.D. | | |
| APG06015 | SGN001325 | RelA | N.D. | | |
| APG06015 | SGN001327 | RelA | N.D. | | |
| APG06015 | SGN001333 | IRA | N.D. | | |
| APG06015 | SGN001334 | TRA | 0.03 | 100% | 0% |
| APG06015 | SGN001335 | TRA | N.D. | | |
| APG06015 | SGN001351 | HAO1 | N.D. | | |
| APG06015 | SGN001352 | HAO1 | N.D. | | |
| APG06015 | SGN001353 | HAO1 | N.D. | | |
| APG09344 | SGN001321 | RelA | 0.02 | 0% | 100% |
| APG09344 | SGN001324 | RelA | N.D. | | |
| APG09344 | SGN001329 | RelA | N.D. | | |
| APG09344 | SGN001336 | TRA | N.D. | | |
| APG09344 | SGN001337 | TRA | N.D. | | |
| APG09344 | SGN001338 | TRA | N.D. | | |
| APG09344 | SGN001354 | HAO1 | N.D. | | |
| APG09344 | SGN001355 | HAO1 | N.D. | | |
| APG09344 | SGN001356 | HAO1 | N.D. | | |
| APG07991 | SGN001312 | RelA | 2.16 | 56.61% | 43.39% |
| APG07991 | SGN001313 | RelA | 2.64 | 80.6% | 19.39% |
| APG07991 | SGN001314 | RelA | 2.49 | 32.48% | 67.51% |
| APG07991 | SGN001339 | TRA | 6.75 | 76.47% | 27.42% |
| APG07991 | SGN001340 | TRA | 6.66 | 69.19% | 33.89% |
| APG07991 | SGN001341 | TRA | 2.84 | 60.63% | 39.38% |
| APG07991 | SGN001357 | HAO1 | 13.34 | 79.66% | 21.31% |
| APG07991 | SGN001358 | HAO1 | 0.05 | 60.78% | 39.22% |
| APG07991 | SGN001359 | HAO1 | 0.21 | 80.53% | 19.48% |
| APG01868 | SGN001315 | RelA | 10.78 | 64.07% | 36.36% |
| APG01868 | SGN001316 | RelA | 6.26 | 87.09% | 13.73% |
| APG01868 | SGN001317 | RelA | 19.42 | 62.57% | 38.11% |
| APG01868 | SGN001342 | TRA | 4.66 | 39.32% | 60.68% |
| APG01868 | SGN001343 | TRA | 41.39 | 60.13% | 41.39% |
| APG01868 | SGN001344 | TRA | 5.42 | 60.46% | 39.53% |
| APG01868 | SGN001360 | HAO1 | 0.38 | 69.28% | 30.72% |
| APG01868 | SGN001361 | HAO1 | 9.48 | 84.92% | 17.07% |
| APG01868 | SGN001362 | HAO1 | 0.32 | 28.97% | 71.03% |
| APG02998 | SGN001318 | RelA | 1.13 | 72.78% | 27.22% |
| APG02998 | SGN001319 | RelA | 2.55 | 91.76% | 8.22% |
| APG02998 | SGN001320 | RelA | 3.48 | 43.97% | 56.04% |
| APG02998 | SGN001345 | TRA | 2.01 | 79.92% | 26.06% |
| APG02998 | SGN001346 | TRA | 5.87 | 40.14% | 61.02% |
| APG02998 | SGN001347 | TRA | 2.26 | 59.08% | 40.89% |
| APG02998 | SGN001363 | HAO1 | 0.4 | 16.34% | 83.66% |
| APG02998 | SGN001364 | HAO1 | N.D. | | |
| APG02998 | SGN001365 | HAO1 | 1.14 | 65.98% | 34.02% |
| APG09208 | SGN000778 | RelA | 0.26 | 0% | 100.00% |
| APG09208 | SGN000793 | AurkB | 1.64 | 50.94% | 49.06% |
| APG09208 | SGN001213 | RelA | 0.05 | 100% | 0.00% |
| APG05586 | SGN001159 | EMX1 | 40.13 | 83.86% | 16.13% |
| APG05586 | SGN001162 | TRA | 46.12 | 86.07% | 14.45% |
| APG05586 | SGN001163 | TRA | 43.77 | 93.38% | 7.58% |
| APG05586 | SGN001164 | TRA | 8 | 95.23% | 4.80% |
| APG05586 | SGN001165 | VEGFA | 65.59 | 98.58% | 2.03% |
| APG05586 | SGN001166 | VEGFA | 10.48 | 94.98% | 5.02% |
| APG05586 | SGN001167 | VEGFA | 43.8 | 92.97% | 7.35% |
| APG08770 | SGN001159 | EMX1 | 11.9 | 80.98% | 20.13% |
| APG08770 | SGN001162 | TRA | 14.57 | 90.2% | 10.24% |
| APG08770 | SGN001163 | TRA | 12.78 | 95.47% | 5.49% |
| APG08770 | SGN001164 | TRA | 3.09 | 92.84% | 9.00% |
| APG08770 | SGN001165 | VEGFA | 23.12 | 92.75% | 8.00% |
| APG08770 | SGN001166 | VEGFA | 10.52 | 93.45% | 6.92% |
| APG08167 | SGN001245 | VEGFA | N.D. | | |
| APG08167 | SGN001246 | VEGFA | N.D. | | |
| APG08167 | SGN001247 | VEGFA | N.D. | | |
| APG08167 | SGN001248 | RelA | N.D. | | |
| APG08167 | SGN001249 | RelA | N.D. | | |
| APG08167 | SGN001250 | RelA | N.D. | | |
| APG08167 | SGN001251 | AurkB | N.D. | | |
| APG08167 | SGN001252 | AurkB | N.D. | | |
| APG08167 | SGN001253 | AurkB | N.D. | | |
| APG01604 | SGN001245 | VEGFA | 69.13 | 96.82% | 7.23% |
| APG01604 | SGN001246 | VEGFA | 4.57 | 79.07% | 24.78% |
| APG01604 | SGN001247 | VEGFA | 18.49 | 96.17% | 5.09% |
| APG01604 | SGN001248 | RelA | 17.04 | 94.78% | 5.61% |
| APG01604 | SGN001249 | RelA | 5.53 | 87.88% | 14.96% |
| APG01604 | SGN001250 | RelA | 21.18 | 81.7% | 19.19% |
| APG01604 | SGN001251 | AurkB | 8.38 | 84.67% | 15.34% |
| APG01604 | SGN001252 | AurkB | 24.74 | 90.49% | 10.22% |
| APG01604 | SGN001253 | AurkB | 0.32 | 86.44% | 13.56% |
| APG03021 | SGN001323 | RelA | 13.73 | 87.67% | 12.31% |
| APG03021 | SGN001326 | RelA | 1.03 | 78.9% | 21.11% |
| APG03021 | SGN001328 | RelA | 7.12 | 92.18% | 9.68% |
| APG03021 | SGN001330 | IRA | N.D. | | |
| APG03021 | SGN001331 | TRA | 0.45 | 23.15% | 76.85% |
| APG03021 | SGN001332 | TRA | 0.25 | 49.44% | 50.57% |
| APG03021 | SGN001348 | HAO1 | 0.08 | 30.16% | 69.84% |
| APG03021 | SGN001349 | HAO1 | 0.03 | 58.33% | 41.67% |
| APG03021 | SGN001350 | HAO1 | 0.36 | 70.53% | 29.48% |

Specific insertions and deletions for respective guides are shown in Tables 6.1-6.3. In these tables, the target sequence is identified by bold upper case letters. The 8mer PAM regions are double underlined, with the main recognized nucleotides in bold. Insertions are identified by lowercase letters. Deletions are indicated with dashes ( - - - ). The INDEL location is calculated from the PAM proximal edge of the target sequence, with the edge being location 0. The location is positive (+) if the location is on the target side of the edge; the location is negative (−) if the location is on the PAM side of the edge.

TABLE 6.1

Specific insertions and deletions for Guide 977 using RGN APG02874

| Guide SGN000977 (SEQ ID NO: 157) | # Reads | % Reads | % of INDELs | Type | INDEL Location | Size |
|---|---|---|---|---|---|---|
| GGAGAGGTTTTAATGGCCCAGCCTCACACCCAGG | 218651 | 99.7 | | | | |
| GGAGAGGTTTTAATGGCCCAG----ACACCCAGG | 161 | 0.07 | 24.88 | Deletion | -1 | 4 |
| GGAGAGGTTTTAATGGCCCAGtacCCTCACACCCAGG | 153 | 0.07 | 23.65 | Insertion | +3 | 3 |
| GGAGAGGTTTTAATGGCCCAG------------G | 137 | 0.06 | 21.17 | Deletion | -9 | 12 |
| GGAGAGGTTTTAATGGCCCAGC------ACCCAGG | 130 | 0.06 | 20.09 | Deletion | -3 | 5 |
| GGAGAGGTTT-AATGGCCCAGCCTCACACCCAGG | 33 | 0.02 | 5.1 | Deletion | +13 | 1 |
| GGAGAGGTTTTAATGGCC-AGCCTCACACCCAGG | 33 | 0.02 | 5.1 | Deletion | +5 | 1 |

TABLE 6.2

Specific insertions and deletions for Guide 985 using RGN APG03850

| Guide SGN000985 (SEQ ID NO: 164) | # Reads | % Reads | % of INDELS | Type | INDEL Location | Size |
|---|---|---|---|---|---|---|
| AGGCTGGGCCATTAAAACCTCTCCAGGGGCCGTG | 218367 | 99.63 | | | | |
| AGGCTGGGCCATTAAAACCTCTCCaAGGGGCCGTG | 268 | 0.12 | 33.37 | Insertion | 3 | 1 |
| AGGCTGGGCCATTAAAACCTCT-CAGGGGCCGTG | 204 | 0.09 | 25.4 | Deletion | 4 | 1 |
| AGGCTGGGCCATTAAAACCTCT-------CCGTG | 140 | 0.06 | 17.43 | Deletion | -2 | 7 |
| AGGCTGGGCCATTAAAACCTCTCC-GGGGCCGTG | 137 | 0.06 | 17.06 | Deletion | 2 | 1 |
| AGGCT-GGCCATTAAAACCTCTCCAGGGGCCGTG | 28 | 0.01 | 3.49 | Deletion | 21 | 1 |
| C----------------------------------------------------------------T | 26 | 0.01 | 3.24 | Deletion | -39 | 88 |

TABLE 6.3

Specific insertions and deletions for Guide 793 using RGN APG09208

| Guide SGN000793 (SEQ ID NO: 170) | # Reads | % Reads | % of INDELs | Type | INDEL Location | Size |
|---|---|---|---|---|---|---|
| AGGTTTTAATGGCCCAGCCTCACACCCAGGTCTG | 169578 | 98.82 | | | | |
| C-------------------------------------------------G | 471 | 0.27 | 23.25 | Deletion | -17 | 80 |
| TGGAGAGGTTTTAATGGCCCAGCCTCACAaCCCAGGTCTGGCCTCCC | 398 | 0.23 | 19.64 | Insertion | +3 | 1 |
| CTGGAGAGGTTTTAATGGCCCAGCCTCACA------------------G | 190 | 0.11 | 9.38 | Deletion | -15 | 18 |
| CTGGAGAGGTTTTAATGGCCCAGCCTCACAC------------TCCC | 133 | 0.08 | 6.56 | Deletion | -10 | 12 |
| CTGGAGAGGTTTTAATGGCCCAGCCTCACACC-AGGTCTGGCCTCCC | 110 | 0.06 | 5.43 | Deletion | 0 | 1 |
| CTGGAGAGGTTTTAATGGCCCAG-------------GTCTGGCCTCCC | 106 | 0.06 | 5.23 | Deletion | -2 | 12 |
| CTGGAGAGGTTTTAATGGCCCAGCCTCACAggCCcAGGTCTGGCCTCCC | 102 | 0.06 | 5.03 | Insertion | +3 | 2 |

TABLE 6.3-continued

Specific insertions and deletions for Guide 793 using RGN APG09208

| Guide SGN000793 (SEQ ID NO: 170) | # Reads | % Reads | % of INDELs | Type | INDEL Location | Size |
|---|---|---|---|---|---|---|
| CTGGAGAGGTTTTAATGGCCCAGCC-------CAGGTCTGGCCTCCC | 92 | 0.05 | 4.54 | Deletion | +1 | 7 |
| CTGGAGAGGTTTTAATGGCCCAGCCTCACAcCCCAGGTCTGGCCTCCC | 82 | 0.05 | 4.05 | Insertion | 0 | 1 |
| CTGGAGAGGTTTTAATGGCCCAGCCTCACActgtttgacctggagccactctctgcaccccgctgaccCCCAGGTCTGGCCTCCC | 61 | 0.04 | 3.01 | Insertion | +3 | 38 |
| C--------------------------------------------TCCC | 50 | 0.03 | 2.47 | Deletion | -10 | 44 |
| CTGGAGAGGTTTTAATGGCCCAGCCTCACAactaggtgtattataagaatcttataaacCCCAGGTCTGGCCTCCC | 48 | 0.03 | 2.37 | Insertion | +3 | 29 |
| CTGGAGAGGTTTTAATGGCCCAGCCTCACAccagctttcgttcgcaactcgagtggaagattggacttgcctgCCCAGGTCTGGCCTCCC | 39 | 0.02 | 1.92 | Insertion | +3 | 43 |
| CTGGAGAGGTTTTAATGGCCCAGCCTC-----------------CC | 36 | 0.02 | 1.78 | Deletion | -12 | 18 |
| CTGGAGAGGTTTTAATGTCCCAGCCTCACAgcactgttcacgtggctgatcatacactgatcacgtgattgatcatCCCAGGTCTGGCCTCCC | 34 | 0.02 | 1.68 | Insertion | +3 | 46 |
| CTGGAGAGGTTTTAATGGCCCA----------------------------T | 27 | 0.02 | 1.33 | Deletion | -23 | 34 |
| CTGGAGAGGTTTTAATGGCCCAGCCTCACAgatgcgacgctgcgcgtcttatactcccacatatgccagattcagcaacggatacCCCAGGTCTGGCCTCCC | 24 | 0.01 | 1.18 | Insertion | +3 | 55 |
| CTGGAGAGGTTTTAATGGCCCagcctcacaggtagctggactatgcatgtgatgctggtgctcaagcagccatcttgccctaagaagtgagagccaggagccaaggatagCCCAGGTCTGGCCTCCC | 23 | 0.01 | 1.14 | Insertion | +3 | 81 |

TABLE 6.4

Specific insertions and deletions for Guide 1166 using RGN APG005586

| Guide SGN001166 (SEQ ID NO: 556) | #Reads | % Reads | % of INDELS | Type | INDEL Location | Size |
|---|---|---|---|---|---|---|
| CGCGCGGACCACGGCTCCTCCGAAGCGAGAACAGCCCAGAAG | 197148 | 89.52 | | | | |
| CGCGCGGACCACGGCTCCTCCGA-----GAACAGCCCAGAAG | 3829 | 1.74 | 16.59 | Deletion | 5 | 0 |
| CGCGCGGACCACGGCTCCTCCGAAG----AACAGCCCAGAAG | 1985 | 0.9 | 8.6 | Deletion | 4 | -1 |
| CGCGCGGACCACGGCTCCTCCGAA-------CAGCCCAGAAG | 1300 | 0.59 | 5.63 | Deletion | 7 | -3 |
| CGCGCGGACCACGGCTCCTCCGAA-CGAGAACAGCCCAGAAG | 1223 | 0.56 | 5.3 | Deletion | 1 | 3 |
| CGCGCGGACCACGGCTCCTCCGAAG-AGAACAGCCCAGAAG | 1221 | 0.55 | 5.29 | Deletion | 2 | 1 |
| CGCGCGGACCACGGCTCCTCCGAA----------------------------------------------------------------C | 936 | 0.43 | 4.06 | Deletion | 117 | -113 |

TABLE 6.4-continued

Specific insertions and deletions for Guide 1166 using RGN APG005586

| Guide SGN001166 (SEQ ID NO: 556) | #Reads | % Reads | % of INDELS | Type | INDEL Location | Size |
|---|---|---|---|---|---|---|
| CGCGCGGACCACGGCTCCTCCGAAGC------<br>---CCAGAAG | 845 | 0.38 | 3.66 | Deletion | 9 | -7 |
| CGCGCGGACCACGGCTCCTCC-----------<br>----------------------------------<br>--------------------T | 715 | 0.32 | 3.1 | Deletion | 64 | -57 |
| CGCGCGGACCACGGCTCCTCCGAAG-------<br>----------------------------------<br>----------------------------------<br>-----G | 615 | 0.28 | 2.66 | Deletion | 140 | -137 |
| CGCGCGGACCACGG------------------<br>----------------------------------<br>----------------------------------<br>-----------------T | 610 | 0.28 | 2.64 | Deletion | 132 | -118 |
| CGCGCGGACCACGGCTCCTCC----CGAGAACA<br>GCCCAGAAG | 551 | 0.25 | 2.39 | Deletion | 4 | 3 |
| CGCGCGGACCACGGCTCCTCCGA-CGAGAACA<br>GCCCAGAAG | 497 | 0.23 | 2.15 | Deletion | 2 | 3 |
| GCGCGGAC cACGGCTCCTCCGAAGTCGAGAACA<br>GCCCAGAAG | 438 | 0.2 | 1.9 | Insertion | 1 | 3 |
| CGCGCGGACCACGGCTCCTCCGAAG-GAGAACA<br>GCCCAGAAG | 381 | 0.17 | 1.65 | Deletion | 1 | 2 |
| G-------------------gaGGCgg------<br>-----------------------G | 334 | 0.15 | 1.45 | Deletion | 49 | -13 |
| CGCGCGGACCACGGCTCCTCCGAA---------<br>-----------------A | 328 | 0.15 | 1.42 | Deletion | 27 | -23 |
| CGCGGACCACGGCTCCTCCGAAGGagGAGAACA<br>GCCCAGAAG | 326 | 0.15 | 1.41 | Insertion | 2 | 2 |
| CGCGCGGACCACGGCTCCTCCGAAGC-------<br>----AGAAG | 321 | 0.15 | 1.39 | Deletion | 11 | -9 |
| CGCGCGGACCACGGCTCCTCCGAAGAG------<br>------------G | 301 | 0.14 | 1.3 | Deletion | 18 | -17 |
| CGCGCGGACCACGGCTCCTCCGAAG--------<br>------AAG | 290 | 0.13 | 1.26 | Deletion | 14 | -11 |
| CGCGCGGACCACGGCTCC--------GAGAACA<br>GCCCAGAAG | 266 | 0.12 | 1.15 | Deletion | 8 | 2 |
| CGCGCGGACCACGGCTCCTC------GAGAACA<br>GCCCAGAAG | 265 | 0.12 | 1.15 | Deletion | 6 | 2 |
| CGCGCGGACCACGGCTC---------GAGAACA<br>GCCCAGAAG | 232 | 0.11 | 1.01 | Deletion | 9 | 2 |
| GCGCGGACCACGGCTCCTCCGAAGcCGAGAACA<br>GCCCAGAAG | 217 | 0.1 | 0.94 | Insertion | 1 | 2 |
| CGCGCGGACCACGGCTCC-------CGAGAACA<br>GCCCAGAAG | 199 | 0.09 | 0.86 | Deletion | 7 | 3 |
| CGCGCGGACCACGGCTCCTCCGAAG--------<br>---------T | 192 | 0.09 | 0.83 | Deletion | 17 | -14 |
| CGCGCGGACCACGGCTCCTCC------------<br>---CAGAAG | 177 | 0.08 | 0.77 | Deletion | 15 | -8 |
| CGCGCGGACCACGGC-----------GAGAACA<br>GCCCAGAAG | 158 | 0.07 | 0.68 | Deletion | 11 | 2 |
| CGCGCGGACCACGGCTCCTCC------------<br>----------------------------------<br>----------------------------------<br>------------------T | 149 | 0.07 | 0.65 | Deletion | 97 | -90 |

TABLE 6.4-continued

Specific insertions and deletions for Guide 1166 using RGN APG005586

| Guide SGN001166 (SEQ ID NO: 556) | #Reads | % Reads | % of INDELS | Type | INDEL Location | Size |
|---|---|---|---|---|---|---|
| CGCGCGGACCACGGC----------CGAGAACA GCCCAGAAG | 147 | 0.07 | 0.64 | Deletion | 10 | 3 |
| CGCGCGGACCACGGCTCC--------------- ---CAGAAG | 131 | 0.06 | 0.57 | Deletion | 18 | -8 |
| CGCGCGGACCACGGCTCCTCCGAAGC------- ---CAGAAG | 127 | 0.06 | 0.55 | Deletion | 10 | -8 |
| CGCGCGGACCACGGCTCCTCCGAAG-------- --------------------------------- ------------G | 124 | 0.06 | 0.54 | Deletion | 53 | -50 |
| CGCGCGGACCACGGCCCCTCCGA-----GAACA GCCCAGAAG | 113 | 0.05 | 0.49 | Deletion | 5 | 0 |
| CGCGCGGACCACGGCTCCTCC------------ ----AGAAG | 112 | 0.05 | 0.49 | Deletion | 16 | -9 |
| CGCGCGGACCACGGCTCC--------------A GCCCAGAAG | 104 | 0.05 | 0.45 | Deletion | 14 | -4 |
| CGCGCGGA--------------------GAACA GCCCAGAAG | 102 | 0.05 | 0.44 | Deletion | 20 | 0 |
| CGCGCGGACCACGGC------------------ --CCAGAAG | 101 | 0.05 | 0.44 | Deletion | 20 | -7 |
| CGCGCG--------------------AGAACA GCCCAGAAG | 98 | 0.04 | 0.42 | Deletion | 21 | 1 |
| CGCGCGGACCACGGCTCCTCCG---CGAGAACA GCCCAGAAG | 97 | 0.04 | 0.42 | Deletion | 3 | 3 |
| CGCGCGGACCACGGCTCCTCCG----------- --------------------------------- -G | 94 | 0.04 | 0.41 | Deletion | 78 | -72 |
| CGCGCGGACCACGGCTCCTCCGAAG---GAACA GCCCAGAAG | 91 | 0.04 | 0.39 | Deletion | 3 | 0 |
| CGCGCGGACCACGGCTCCTCCGAAG-------- ----AGAAG | 90 | 0.04 | 0.39 | Deletion | 12 | -9 |
| CGCGC-------------------------- --CCAGAAG | 80 | 0.04 | 0.35 | Deletion | 30 | -7 |
| GCGCGGACCACGGCTCCTCCGAAGcCCAGAACA GCCCAGAAG | 74 | 0.03 | 0.32 | Insertion | 1 | 1 |
| C------------------------------ ----------------------AGAAG | 73 | 0.03 | 0.32 | Deletion | 56 | -9 |
| CGCGCGGACCACGGCTCCTCCGAAG-------- --------------------------------- ------A | 67 | 0.03 | 0.29 | Deletion | 47 | -44 |
| CGCGCGGACCACGGCTCCTCCGAA-CGAGAACA GCCCAGACG | 66 | 0.03 | 0.29 | Deletion | 1 | 3 |
| CGCGCGGACCACGGCTC---------------- ----AGAAG | 63 | 0.03 | 0.27 | Deletion | 20 | -9 |
| CGCGCGGACC---------------------- ----CAGAAG | 63 | 0.03 | 0.27 | Deletion | 26 | -8 |
| CGCGCGGACCACGGCTCCTCCG----------- --------------------------------- --------------------------------- --------------------------------- --------------------------------- ---T | 62 | 0.03 | 0.27 | Deletion | 179 | -173 |

TABLE 6.4-continued

Specific insertions and deletions for Guide 1166 using RGN APG005586

| Guide SGN001166 (SEQ ID NO: 556) | #Reads | % Reads | % of INDELS | Type | INDEL Location | Size |
|---|---|---|---|---|---|---|
| C-----------------------------------AGAAG | 60 | 0.03 | 0.26 | Deletion | 51 | -9 |
| CGCGCGGACCACGGCTCCTCC-----------A GCCCAGAAG | 59 | 0.03 | 0.26 | Deletion | 11 | -4 |
| CGCGCGGACCAC------------------------AGAAG | 56 | 0.03 | 0.24 | Deletion | 25 | -9 |
| CGCGCGGAC-----------------GAGAACA GCCCAGAAG | 55 | 0.02 | 0.24 | Deletion | 17 | 2 |
| CGCGCGGACCACGGCTCCTCT----CGAGAACA GCCCAGAAG | 54 | 0.02 | 0.23 | Deletion | 4 | 3 |
| CGCGCGGACCACGGCTCCTCCGAAG--------GCCCAGAAG | 54 | 0.02 | 0.23 | Deletion | 8 | -5 |
| G-----------------------------------AGAACAGCCCAGAAG | 53 | 0.02 | 0.23 | Deletion | 39 | 1 |
| CGCGCGGACCA----------------------------GAAG | 52 | 0.02 | 0.23 | Deletion | 27 | -10 |
| CGCGCGGACCACGGCTCC-----------------AGAAG | 52 | 0.02 | 0.23 | Deletion | 19 | -9 |
| CGCGCGGACCACGGCTCCTCCG----GAGAACA GCCCAGAAG | 50 | 0.02 | 0.22 | Deletion | 4 | 2 |
| CGCGCGGACCACGGCTCC----------------CCCAGAAG | 48 | 0.02 | 0.21 | Deletion | 16 | -6 |
| CGCGCGGACCACGGCTCCTCCGA-----------GAAG | 48 | 0.02 | 0.21 | Deletion | 15 | -10 |
| CGCGCGGA--------------------ACA GCCCAGAAG | 47 | 0.02 | 0.2 | Deletion | 22 | 2 |
| CGCGCGGACCACGGCTCCTCCGAAG-----ACA GCCCAGAAG | 46 | 0.02 | 0.2 | Deletion | 5 | -2 |
| CGCGCGGACCACGGCTCCT-----GCGAGAACA GCCCAGAAG | 45 | 0.02 | 0.19 | Deletion | 5 | 4 |
| CGCGCGGACC---------------CGAGAACA GCCCAGAAG | 45 | 0.02 | 0.19 | Deletion | 15 | 3 |
| CGCG---------------------AGAACA GCCCAGAAG | 44 | 0.02 | 0.19 | Deletion | 23 | 1 |
| CGCGCGGACCA-----------------GAACA GCCCAGAAG | 44 | 0.02 | 0.19 | Deletion | 17 | 0 |
| CG----------------------------A GCCCAGAAG | 44 | 0.02 | 0.19 | Deletion | 30 | -4 |
| CGCGCGGACCACGGCTCCTCCGA-----GAACA GCCCAGACG | 44 | 0.02 | 0.19 | Deletion | 5 | 0 |
| CGCGCGGACCACGGCTCCTCGGA-----GAACA GCCCAGAAG | 42 | 0.02 | 0.18 | Deletion | 5 | 0 |
| CGCGCGGACCACGGCTCCTCCTC-CGAGAACA GCCCAGAAG | 42 | 0.02 | 0.18 | Deletion | 2 | 3 |
| CGCGCGG-----------------GGAAGAACA GCCCAGAAG | 41 | 0.02 | 0.18 | Deletion | 17 | 4 |
| CGCGCGGACCACGGCTCCTCCGAAG----------GAAG | 39 | 0.02 | 0.17 | Deletion | 13 | -10 |
| CGCGCGGACC----------------GAGAACA GCCCAGAAG | 39 | 0.02 | 0.17 | Deletion | 16 | 2 |

TABLE 6.4-continued

Specific insertions and deletions for Guide 1166 using RGN APG005586

| Guide SGN001166 (SEQ ID NO: 556) | #Reads | % Reads | % of INDELS | Type | INDEL Location | Size |
|---|---|---|---|---|---|---|
| CGCGCGGACCACGGCTCCTCCGAAG---------<br>-----GA----G | 39 | 0.02 | 0.17 | Deletion | 17 | -16 |
| GCGGACCACGGCTCCTCCGAAGaagCGAGAACA<br>GCCCAGAAG | 38 | 0.02 | 0.16 | Insertion | 3 | 3 |
| GGACCACGGCTCCTCCGAAGGAGGagGAGAACA<br>GCCCAGAAG | 38 | 0.02 | 0.16 | Insertion | 5 | 2 |
| CGCGCGGACCAC---------------------<br>------AAG | 38 | 0.02 | 0.16 | Deletion | 27 | -11 |
| CGCGCGGACCACGGCTCCTCCGAAGC------A<br>GCCCAGAAG | 38 | 0.02 | 0.16 | Deletion | 6 | -4 |
| T--------------------------------<br>---------------T | 37 | 0.02 | 0.16 | Deletion | 47 | -15 |
| CGCGCGGACCACGGCTGTTCTGA-----GAACA<br>GCCCAGAAG | 37 | 0.02 | 0.16 | Deletion | 5 | 0 |
| C--------------------------<br>CGAGAACAGCCCAGAAG | 36 | 0.02 | 0.16 | Deletion | 31 | 3 |
| CGCGCGGACCACGGC------------------<br>------GAAG | 36 | 0.02 | 0.16 | Deletion | 23 | -10 |
| CGCGCGGA-------------------------<br>-------AG | 35 | 0.02 | 0.15 | Deletion | 32 | -12 |
| CGCGCGGACCACGG---------------AACA<br>GCCCAGAAG | 34 | 0.02 | 0.15 | Deletion | 15 | -1 |
| CGCGCGGACCACGGCTC------------AACA<br>GCCCAGAAG | 34 | 0.02 | 0.15 | Deletion | 12 | -1 |
| CGCGCGGACCACGGCCCCTCC----CGAGAACA<br>GCCCAGAAG | 33 | 0.01 | 0.14 | Deletion | 4 | 3 |
| G--------------------------------<br>-----------------------A | 33 | 0.01 | 0.14 | Deletion | 57 | -21 |
| CGCGCGGACCACGGCTCCTCCGA-GCGAGAACA<br>GCCCAGAAG | 32 | 0.01 | 0.14 | Deletion | 1 | 4 |
| CGCGCGGACCACGTT----------CGAGAACA<br>GCCCAGAAG | 32 | 0.01 | 0.14 | Deletion | 10 | 3 |
| CGCGA---------------------AGAACA<br>GCCCAGAAG | 31 | 0.01 | 0.13 | Deletion | 22 | 1 |
| CGCGCGGACCACGG-------------------<br>------AAG | 31 | 0.01 | 0.13 | Deletion | 25 | -11 |
| CGCG-----------------------AACA<br>GCCC----------G | 30 | 0.01 | 0.13 | Deletion | 36 | -20 |
| CGCGCGGACCACGGCTCCTCCGAAG----AACA<br>GCCCAGCAG | 30 | 0.01 | 0.13 | Deletion | 4 | -1 |
| CGCGCGGACCACGGCTCCT---------GAACA<br>GCCCAGAAG | 30 | 0.01 | 0.13 | Deletion | 9 | 0 |
| CGCGGACCACGGCTCCTCCGAAGcGCGAGAACA<br>GCCCAGAAG | 30 | 0.01 | 0.13 | Insertion | 2 | 1 |
| CG-----------------------<br>AGAACAGCCCAGAAG | 29 | 0.01 | 0.13 | Deletion | 25 | 1 |
| CGCGCGGACCACGGCCCCTCCGAAG----<br>AACAGCCCAGAAG | 29 | 0.01 | 0.13 | Deletion | 4 | -1 |
| CGCGCGGACCAC--------------------<br>AGCCCAGAAG | 29 | 0.01 | 0.13 | Deletion | 20 | -4 |

TABLE 6.4-continued

Specific insertions and deletions for Guide 1166 using RGN APG005586

| Guide SGN001166 (SEQ ID NO: 556) | #Reads | % Reads | % of INDELS | Type | INDEL Location | Size |
|---|---|---|---|---|---|---|
| CGCGCGGACCACGG----------------ACAGCCCAGAAG | 29 | 0.01 | 0.13 | Deletion | 16 | -2 |
| CGCGCGGACCACGGCTCCTC-----------------AGAAG | 28 | 0.01 | 0.12 | Deletion | 17 | -9 |

The robustness of several nucleases was tested by assaying their ability to edit at many different target sites across several genes. Over 40 targets were tested in the expanded guide panel. All proteins tested showed robust editing at the diverse sites. Results are shown in Table 7.

TABLE 7

Robustness of select RNA-guided nucleases

| RGN | Gene | SGN Number | Overall Editing Rate (%) |
|---|---|---|---|
| APG01868 | TRA | SGN001684 | 42.62 |
| | | SGN001685 | 1.43 |
| | | SGN001686 | 8.19 |
| | | SGN001687 | 8.83 |
| | | SGN001688 | 0.21 |
| | | SGN001689 | 0 |
| | | SGN001690 | 0 |
| | | SGN001691 | 20.86 |
| | EMX1 | SGN001697 | 0.93 |
| | | SGN001698 | 0 |
| | | SGN001699 | 18.84 |
| | | SGN001700 | 21.8 |
| | | SGN001701 | 39.94 |
| | | SGN001702 | 2.16 |
| | | SGN001703 | 0.79 |
| | | SGN001704 | 3.49 |
| | | SGN001705 | 14.49 |
| | | SGN001706 | 1.04 |
| | | SGN001707 | 2.51 |
| | | SGN001708 | 1.75 |
| | | SGN001709 | 3.62 |
| | | SGN001710 | 0 |
| | | SGN001711 | 13.39 |
| | HAO1 | SGN001713 | 22.29 |
| | | SGN001714 | 0.67 |
| | | SGN001715 | 0.23 |
| | | SGN001716 | 7.1 |
| | | SGN001717 | 0.68 |
| | | SGN001718 | 0.21 |
| | | SGN001719 | 0 |
| | | SGN001721 | 0.17 |
| | | SGN001722 | 1.36 |
| | | SGN001723 | 24.16 |
| | | SGN001724 | 0.2 |
| | LDHA | SGN001725 | 4.92 |
| | | SGN001726 | 0 |
| | | SGN001727 | 1.32 |
| | | SGN001728 | 0.28 |
| | | SGN001729 | 1.94 |
| | | SGN001730 | 5.2 |
| | | SGN001731 | 11.28 |
| | | SGN001732 | 6.04 |
| | | SGN001733 | 1.12 |
| | | SGN001734 | 2.11 |
| | | SGN001735 | 7 |

TABLE 7-continued

Robustness of select RNA-guided nucleases

| RGN | Gene | SGN Number | Overall Editing Rate (%) |
|---|---|---|---|
| APG05586 | TRA | SGN001371 | 30.52 |
| | | SGN001372 | 26.01 |
| | | SGN001373 | 26.67 |
| | | SGN001374 | 22.94 |
| | | SGN001375 | 21.17 |
| | | SGN001376 | 0 |
| | | SGN001377 | 0 |
| | | SGN001378 | 30.04 |
| | | SGN001379 | 39.13 |
| | | SGN001380 | 4.93 |
| | | SGN001381 | 17.14 |
| | | SGN001382 | 5.6 |
| | B2M | SGN001383 | 36.23 |
| | | SGN001384 | 44.28 |
| | | SGN001385 | 6.33 |
| | | SGN001386 | 5.55 |
| | | SGN001387 | 48.71 |
| | | SGN001388 | 31.78 |
| | | SGN001389 | 41 |
| | | SGN001390 | 48.15 |
| | | SGN001391 | 46.19 |
| | | SGN001392 | 37.22 |
| | | SGN001393 | 31.62 |
| | | SGN001394 | 29.72 |
| | LDHA | SGN001396 | 32.88 |
| | | SGN001397 | 41.45 |
| | | SGN001399 | 43.28 |
| | | SGN001400 | 2.52 |
| | | SGN001401 | 37.52 |
| | | SGN001402 | 0.37 |
| | | SGN001403 | 53.13 |
| | | SGN001404 | 44.06 |
| | | SGN001405 | 1.46 |
| | HAO1 | SGN001406 | 21.98 |
| | | SGN001407 | 9.13 |
| | | SGN001408 | 25.06 |
| | | SGN001409 | 43.81 |
| | | SGN001410 | 37.6 |
| | | SGN001411 | 40.75 |
| | | SGN001412 | 18.2 |
| | | SGN001413 | 28.44 |
| | | SGN001414 | 29.39 |
| | | SGN001415 | 0.39 |
| | | SGN001416 | 43.59 |
| APG01604 | B2M | SGN001592 | 23.77 |
| | | SGN001593 | 22.7 |
| | | SGN001594 | 23.6 |
| | | SGN001595 | 33.23 |
| | | SGN001596 | 20.88 |
| | | SGN001597 | 1.26 |
| | | SGN001598 | 26.7 |
| | | SGN001599 | 9.41 |
| | | SGN001600 | 28.88 |
| | | SGN001601 | 7.39 |
| | | SGN001602 | 27.8 |
| | | SGN001603 | 6.93 |

TABLE 7-continued

Robustness of select RNA-guided nucleases

| RGN | Gene | SGN Number | Overall Editing Rate (%) |
|---|---|---|---|
| | HAO1 | SGN001616 | 0 |
| | | SGN001617 | 2.55 |
| | | SGN001618 | 0.6 |
| | | SGN001619 | 6.29 |
| | | SGN001620 | 7.92 |
| | | SGN001621 | 13.03 |
| | | SGN001622 | 5.32 |
| | | SGN001623 | 18.58 |
| | | SGN001624 | 20.03 |
| | | SGN001625 | 1.65 |
| | | SGN001626 | 0.18 |
| | | SGN001627 | 0.73 |
| | LDHA | SGN001640 | 3.75 |
| | | SGN001641 | 1.13 |
| | | SGN001642 | 14.2 |
| | | SGN001643 | 12.16 |
| | | SGN001644 | 4.9 |
| | | SGN001645 | 4.78 |
| | | SGN001646 | 0.74 |
| | | SGN001647 | 2.89 |
| | | SGN001648 | 0 |
| | | SGN001649 | 0.15 |
| | | SGN001650 | 4.4 |
| | | SGN001651 | 7.26 |
| | TRA | SGN001664 | 0.44 |
| | | SGN001665 | 3.4 |
| | | SGN001666 | 17.24 |
| | | SGN001667 | 2.33 |
| | | SGN001668 | 0.3 |
| | | SGN001669 | 13.68 |
| | | SGN001670 | 0.54 |
| | | SGN001671 | 5.09 |
| | | SGN001672 | 0.22 |
| | | SGN001673 | 12.22 |
| | | SGN001674 | 17.33 |
| | | SGN001675 | 11.69 |
| APG09298 | B2M | SGN001383 | 22.25 |
| | | SGN001384 | 9.5 |
| | | SGN001385 | 2.37 |
| | | SGN001386 | 0.4 |
| | | SGN001387 | 38.03 |
| | | SGN001388 | 17.66 |
| | | SGN001389 | 42.03 |
| | | SGN001390 | 42.88 |
| | | SGN001391 | 16.31 |
| | | SGN001392 | 16.5 |
| | | SGN001393 | 6.27 |
| | | SGN001394 | 17.15 |
| | HAO1 | SGN001406 | 3.46 |
| | | SGN001407 | 1.87 |
| | | SGN001408 | 10.71 |
| | | SGN001409 | 18.79 |
| | | SGN001410 | 15.09 |
| | | SGN001411 | 14.81 |
| | | SGN001412 | 0.63 |
| | | SGN001413 | 5.92 |
| | | SGN001414 | 5.24 |
| | | SGN001415 | 0.03 |
| | | SGN001416 | 15.41 |
| | LDHA | SGN001395 | 3.15 |
| | | SGN001396 | 28.53 |
| | | SGN001397 | 11.69 |
| | | SGN001399 | 23.92 |
| | | SGN001400 | 0.89 |
| | | SGN001401 | 33.97 |
| | | SGN001402 | 0 |
| | | SGN001403 | 25.62 |
| | | SGN001404 | 16.96 |
| | | SGN001405 | 0.11 |
| | TRA | SGN001162 | 44.26 |
| | | SGN001163 | 42.06 |
| | | SGN001164 | 8.1 |
| | | SGN001371 | 21.05 |
| | | SGN001372 | 3.95 |
| | | SGN001373 | 7.8 |
| | | SGN001374 | 9.04 |
| | | SGN001375 | 2.94 |
| | | SGN001376 | 0 |
| | | SGN001377 | 0 |
| | | SGN001378 | 22.14 |
| | | SGN001379 | 27.43 |
| | | SGN001380 | 0.16 |
| | | SGN001381 | 14.18 |
| | | SGN001382 | 2.78 |

Example 5: Protein Engineering of APG05586

Conserved and variable residues of APG05586 were identified by comparison of APG05586 to closely related homologs, including APG08770 (SEQ ID NO: 70), APG09882 (set forth as SEQ ID NO: 568 and described in International Appl. No. PCT/US2020/045759, which is incorporated by reference in its entirety), and APG01658 (set forth as SEQ ID NO: 569 and described in International Appl. No. PCT/US2020/045759). Several variants were generated containing mutations at the nonconserved locations to identify critical residues in the APG05586 protein. In total, 132 residues were altered in ten APG05586 engineered variant RGNs (SEQ ID NOs: 570-579). These ten APG05586 variants and wild type APG05586 were then assayed for activity in mammalian cells. Using the guide RNA backbone for APG05586 (SEQ ID NO: 66), the RGNs were tested for activity at six targeted genomic locations (Table 8) following the methods described in Example 4. Mammalian codon-optimized coding sequences for each variant are provided as SEQ ID NOs: 580-589. 5' and 3' primer nucleotide sequences useful for detection of gene editing activity are also provided in Table 8. Editing rates are shown in Table 9.

TABLE 8

Target sequences

| Guide ID | Gene | Target Sequence (SEQ ID NO.) | sgRNA (SEQ ID NO.) | 5' Primer for amplification | 3' Primer for amplification |
|---|---|---|---|---|---|
| SGN001159 | EMX1 | 590 | 591 | 592 | 593 |
| SGN001162 | TRA | 594 | 595 | 596 | 597 |
| SGN001163 | TRA | 598 | 599 | 596 | 597 |
| SGN001164 | TRA | 600 | 601 | 596 | 597 |
| SGN001165 | VEGFA | 602 | 603 | 604 | 605 |
| SGN001166 | VEGFA | 606 | 607 | 604 | 605 |

TABLE 9

Editing rates for APG05586 and variants thereof

| RGN ID | RGN SEQ ID NO. | SGN001159 | SGN001162 | SGN001163 | SGN001164 | SGN001165 | SGN001166 |
|---|---|---|---|---|---|---|---|
| APG09298 | 570 | 33.40% | 44.26% | 42.06% | 8.10% | 33.94% | 46.19% |
| APG06251 | 571 | 0% | 43.59% | 48.82% | 5.90% | 25.07% | 35.08% |
| APG03066 | 572 | 0% | 0% | 0% | 0% | 0% | 0% |
| APG01560 | 573 | 15.12% | 16.38% | 17.59% | 2.52% | 44.99% | 20.68% |
| APG02777 | 574 | 0% | 0.08% | 0% | 0% | 0% | 0% |
| APG05761 | 575 | 24.25% | 21.95% | 21.86% | 10.45% | 23.72% | 20.17% |
| APG02479 | 576 | 5.61% | 9.25% | 11.00% | 1.45% | 4.53% | 6.34% |
| APG08385 | 577 | 31.16% | 39.95% | 35.42% | 2.37% | 31.41% | 26.65% |
| APG09217 | 578 | 29.43% | 41.12% | 44.71% | 4.79% | 38.16% | 31.76% |
| APG06657 | 579 | 36.81% | 44.20% | 41.54% | 4.44% | 16.29% | 21.86% |
| APG05586 | 63 | 40.13% | 46.12% | 43.77% | 8.00% | 96.76% | 77.38% |

The relative activity of the variants suggests which locations in the protein tolerate mutations. Table 10 shown below is a summary of the activity of the variant RGN with the number of mutations introduced compared to APG005586. "−" is no activity; "+" is 1-15% editing in at least 4 out of 6 targets; "++" is 10-25% editing in at least 4 out of 6 targets; and "+++" is 20-50% editing in at least 4 out of 6 targets.

TABLE 10

Summary of protein engineering changes and editing rates

| Protein | Activity Outcome | Number of mutations |
|---|---|---|
| APG09298 | +++ | 10 |
| APG06251 | +++ | 12 |
| APG03066 | − | 87 |
| APG01560 | ++ | 10 |
| APG02777 | − | 37 |
| APG05761 | ++ | 10 |
| APG02479 | + | 12 |
| APG08385 | +++ | 12 |
| APG09217 | +++ | 14 |
| APG06657 | +++ | 14 |
| APG05586 | +++ | 0 |

Variants APG03066 and APG02777 contained too many mutations to identify specific residues important for function, however, the low activity of these variants indicates that extensive changes to the bridge helix and recognition domain are not tolerated in this protein. All other variants contained 14 or fewer mutations, which enabled identification of specific residues important for activity. Based on these results, several residues were identified as important for function of the protein. I305L, V328A, L366I, T368S, and V405A mutations resulted in decreased activity in the assayed variants. All of these mutations are predicted to be in the recognition domain of the protein. The decrease in activity for APG01560 is a result of multiple changes that are not localized to a specific region within the protein.

Example 6: Identification of Disease Targets

A database of clinical variants was obtained from NCBI ClinVar database, which is available through the world wide web at the NCBI ClinVar website. Pathogenic Single Nucleotide Polymorphisms (SNPs) were identified from this list. Using the genomic locus information, CRIgvSPR targets in the region overlapping and surrounding each SNP were identified. A selection of SNPs that can be corrected using base editing in combination with the RGNs of the invention to target the causal mutation ("Casl Mut.") is listed in Table 11. In Table 11, only one alias of each disease is listed. The "RS #" corresponds to the RS accession number through the SNP database at the NCBI website. The AlleleID corresponds to a causal allele accession number, and the Chromosome Accession number also provides accession reference information found through the NCBI website. Table 11 also provides genomic target sequence information suitable for the RGN listed for each disease. The target sequence information also provides protospacer sequence for the production of the necessary sgRNA for the corresponding RGN of the invention.

TABLE 11

Disease Targets for RGNs

| Disease | RS# | RGN | Casl Mut. | Allele ID | Chromosome Accession | Gene Symbol | Target (SEQ ID NO.) |
|---|---|---|---|---|---|---|---|
| Stargardt disease 1 | 1800553 | APG06622 | C > T | 22927 | NC_000001.10, NC_000001.11 | ABCA4 | 261 |
| Stargardt disease 1 | 1800728 | APG06622 | A > G | 98777 | NC_000001.10, NC_000001.11 | ABCA4 | 262 |
| Stargardt disease 1 | 61751374 | APG06622 | G > A | 22933 | NC_000001.10, NC_000001.11 | ABCA4 | 263 |
| Stargardt disease 1 | 61750641 | APG02874, APG03031, APG09208 | G > A | 105317 | NC_000001.10, NC_000001.11 | ABCA4 | 264 |
| Stargardt disease 1 | 1800553 | APG02787 | G > A | 22927 | NC_000001.10, NC_000001.11 | ABCA4 | 265 |
| Stargardt disease 1 | 1800553 | APG06007 | G > A | 22927 | NC_000001.10, NC_000001.11 | ABCA4 | 266 |
| Stargardt disease 1 | 1800553 | APG03850 | G > A | 22927 | NC_000001.10, NC_000001.11 | ABCA4 | 267 |
| Stargardt disease 1 | 1800553 | APG05586 | G > A | 22927 | NC_000001.10, NC_000001.11 | ABCA4 | 268 |

TABLE 11-continued

Disease Targets for RGNs

| Disease | RS# | RGN | Casl Mut. | Allele ID | Chromosome Accession | Gene Symbol | Target (SEQ ID NO.) |
|---|---|---|---|---|---|---|---|
| Stargardt disease 1 | 1800553 | APG08167, APG01604 | C > T | 22927 | NC_000001.10, NC_000001.11 | ABCA4 | 269 |
| Familial hyperinsulinism | 1.51E+08 | APG02874, APG03031, APG09208 | G > A | 24127 | NC_000011.9, NC_000011.10 | ABCC8 | 270 |
| Very long chain acyl-CoA dehydrogenase deficiency | 1.14E+08 | APG06622 | T > C | 33877 | NC_000017.10, NC_000017.11 | ACADVL | 271 |
| Very long chain acyl-CoA dehydrogenase deficiency | 1.14E+08 | APG06248 | T > C | 33877 | NC_000017.10, NC_000017.11 | ACADVL | 272 |
| Very long chain acyl-CoA dehydrogenase deficiency | 3.7E+08 | APG02874, APG03031, APG09208 | G > A | 98197 | NC_000017.10, NC_000017.11 | ACADVL | 273 |
| Baraitser-Winter syndrome 1 | 2.82E+08 | APG02874, APG03031, APG09208 | G > A | 38553 | NC_000007.13, NC_000007.14 | ACTB | 274 |
| Severe immunodeficiency due to ADA deficiency | 1.22E+08 | APG02874, APG03031, APG09208 | G > A | 16996 | NC_000020.10, NC_000020.11 | ADA | 275 |
| Severe immunodeficiency due to ADA deficiency | 1.22E+08 | APG02874, APG03031, APG09208 | T > C | 17004 | NC_000020.10, NC_000020.11 | ADA | 276 |
| Primary hyperoxaluria | 1.22E+08 | APG06622 | G > A | 38436 | NC_000002.11, NC_000002.12 | AGXT | 277 |
| Congenital disorder of glycosylation | 28939378 | APG06622 | C > T | 19763 | NC_000016.9, NC_000016.10 | ALG1 | 278 |
| Hypophosphatasia | 1.22E+08 | APG06622 | G > A | 28709 | NC_000001.10, NC_000001.11 | ALPL | 279 |
| Hypophosphatasia | 1.22E+08 | APG02874, APG03031, APG09208 | G > A | 28709 | NC_000001.10, NC_000001.11 | ALPL | 280 |
| Colorectal cancer | 1.38E+08 | APG06622 | C > T | 15837 | NC_000005.9, NC_000005.10 | APC | 281 |
| Metachromatic leukodystrophy | 80338815 | APG06622 | C > T | 18090 | NC_000022.10, NC_000022.11 | ARSA | 282 |
| Wilson disease | 1.94E+08 | APG02874, APG03031, APG09208 | G > A | 44393 | NC_000013.10, NC_000013.11 | ATP7B | 283 |
| Cardio-facio-cutaneous syndrome | 1.8E+08 | APG06622 | T > C | 29012 | NC_000007.13, NC_000007.14 | BRAF | 284 |
| Cardio-facio-cutaneous syndrome | 1.8E+08 | APG06248 | T > C | 29012 | NC_000007.13, NC_000007.14 | BRAF | 285 |
| Breast and/or ovarian cancer | 41293455 | APG06622 | G > A | 32714 | NC_000017.10, NC_000017.11 | BRCA1 | 286 |
| Breast and/or ovarian cancer | 41293465 | APG06622 | G > A | 70268 | NC_000017.10, NC_000017.11 | BRCA1 | 287 |
| Breast and colorectal cancer | 55770810 | APG06622 | G > A | 70063 | NC_000017.10, NC_000017.11 | BRCA1 | 288 |
| Breast and/or ovarian cancer | 62625307 | APG06622 | G > A | 69596 | NC_000017.10, NC_000017.11 | BRCA1 | 289 |
| Breast and/or ovarian cancer | 62625308 | APG06622 | G > A | 32710 | NC_000017.10, NC_000017.11 | BRCA1 | 290 |
| Breast and/or ovarian cancer | 80356962 | APG06622 | C > T | 70247 | NC_000017.10, NC_000017.11 | BRCA1 | 291 |
| Breast and/or ovarian cancer | 41293455 | APG02787 | C > T | 32714 | NC_000017.10, NC_000017.11 | BRCA1 | 292 |
| Breast and/or ovarian cancer | 41293455 | APG06007 | C > T | 32714 | NC_000017.10, NC_000017.11 | BRCA1 | 293 |
| Breast and/or ovarian cancer | 41293455 | APG03850 | C > T | 32714 | NC_000017.10, NC_000017.11 | BRCA1 | 294 |
| Breast and/or ovarian cancer | 41293455 | APG05586 | C > T | 32714 | NC_000017.10, NC_000017.11 | BRCA1 | 295 |
| Breast and/or ovarian cancer | 41293455 | APG08167, APG01604 | G > A | 32714 | NC_000017.10, NC_000017.11 | BRCA1 | 296 |
| Breast and/or ovarian cancer | 80356962 | APG08167, APG01604 | C > T | 70247 | NC_000017.10, NC_000017.11 | BRCA1 | 297 |
| Breast and/or ovarian cancer | 80358163 | APG08167, APG01604 | T > C | 46006 | NC_000017.10, NC_000017.11 | BRCA1 | 298 |
| Breast and/or ovarian cancer | 45580035 | APG06622 | C > T | 67431 | NC_000013.10, NC_000013.11 | BRCA2 | 299 |
| Breast and/or ovarian cancer | 80359212 | APG06622 | C > T | 67494 | NC_000013.10, NC_000013.11 | BRCA2 | 300 |
| Breast and/or ovarian cancer | 80359003 | APG02874, APG03031, APG09208 | G > A | 67069 | NC_000013.10, NC_000013.11 | BRCA2 | 301 |
| Breast and/or ovarian cancer | 80359004 | APG02874, APG03031, APG09208 | G > A | 46672 | NC_000013.10, NC_000013.11 | BRCA2 | 302 |

TABLE 11-continued

Disease Targets for RGNs

| Disease | RS# | RGN | Cas1 Mut. | Allele ID | Chromosome Accession | Gene Symbol | Target (SEQ ID NO.) |
|---|---|---|---|---|---|---|---|
| Breast and/or ovarian cancer | 80359212 | APG02787 | C > T | 67494 | NC_000013.10, NC_000013.11 | BRCA2 | 303 |
| Breast and/or ovarian cancer | 80359212 | APG06007 | C > T | 67494 | NC_000013.10, NC_000013.11 | BRCA2 | 304 |
| Breast and/or ovarian cancer | 80359212 | APG03850 | C > T | 67494 | NC_000013.10, NC_000013.11 | BRCA2 | 305 |
| Breast and/or ovarian cancer | 80359212 | APG05586 | C > T | 67494 | NC_000013.10, NC_000013.11 | BRCA2 | 306 |
| Breast and/or ovarian cancer | 80359212 | APG08167, APG01604 | C > T | 67494 | NC_000013.10, NC_000013.11 | BRCA2 | 307 |
| Breast and/or ovarian cancer | 80359071 | APG08167, APG01604 | G > A | 67203 | NC_000013.10, NC_000013.11 | BRCA2 | 308 |
| CAPN3-Related Disorders | 1.21E+08 | APG02874, APG03031, APG09208 | G > A | 32661 | NC_000015.9, NC_000015.10 | CAPN3; POMT1 | 309 |
| CBS-deficiency | 5742905 | APG06622 | A > G | 15159 | NC_000021.8, NC_000021.9 | CBS | 310 |
| CBS-deficiency | 5742905 | APG02874, APG03031, APG09208 | T > C | 15159 | NC_000021.8, NC_000021.9 | CBS | 311 |
| CBS-deficiency | 1.22E+08 | APG02874, APG03031, APG09208 | G > A | 15156 | NC_000021.8, NC_000021.9 | CBS | 312 |
| Cystic fibrosis | 77010898 | APG06622 | G > A | 22168 | NC_000007.13, NC_000007.14 | CFTR | 313 |
| Cystic fibrosis | 75096551 | APG02874, APG03031, APG09208 | G > A | 33858 | NC_000007.13, NC_000007.14 | CFTR | 314 |
| Cystic fibrosis | 75527207 | APG02787 | G > A | 22159 | NC_000007.13, NC_000007.14 | CFTR | 315 |
| Cystic fibrosis | 75527207 | APG06007 | G > A | 22159 | NC_000007.13, NC_000007.14 | CFTR | 316 |
| Cystic fibrosis | 75527207 | APG03850 | G > A | 22159 | NC_000007.13, NC_000007.14 | CFTR | 317 |
| Cystic fibrosis | 75527207 | APG05586 | G > A | 22159 | NC_000007.13, NC_000007.14 | CFTR | 318 |
| Cystic fibrosis | 78655421 | APG02787 | G > A | 22148 | NC_000007.13, NC_000007.14 | CFTR | 319 |
| Cystic fibrosis | 78655421 | APG06007 | G > A | 22148 | NC_000007.13, NC_000007.14 | CFTR | 320 |
| Cystic fibrosis | 78655421 | APG03850 | G > A | 22148 | NC_000007.13, NC_000007.14 | CFTR | 321 |
| Cystic fibrosis | 78655421 | APG05586 | G > A | 22148 | NC_000007.13, NC_000007.14 | CFTR | 322 |
| Cystic fibrosis | 75527207 | APG08167, APG01604 | G > A | 22159 | NC_000007.13, NC_000007.14 | CFTR | 323 |
| Congenital myotonia | 80356701 | APG02874, APG03031, APG09208 | T > C | 33902 | NC_000007.13, NC_000007.14 | CLCN1 | 324 |
| Osteogenesis imperfecta type 1 | 72645321 | APG02874, APG03031, APG09208 | G > A | 414022 | NC_000017.10, NC_000017.11 | COL1A1 | 325 |
| Osteogenesis imperfecta type 1 | 72645321 | APG02874, APG03031, APG09208 | G > A | 414022 | NC_000017.10, NC_000017.11 | COL1A1 | 326 |
| Alport syndrome 1, X-linked recessive | 1.05E+08 | APG02874, APG03031, APG09208 | G > A | 35796 | NC_000023.10, NC_000023.11 | COL4A5 | 327 |
| Carnitine palmitoyltransferase II deficiency | 74315294 | APG06622 | C > T | 23992 | NC_000001.10, NC_000001.11 | CPT2 | 328 |
| Carnitine palmitoyltransferase II deficiency | 74315294 | APG06248 | C > T | 23992 | NC_000001.10, NC_000001.11 | CPT2 | 329 |
| Carnitine palmitoyltransferase II deficiency | 74315294 | APG06007 | C > T | 23992 | NC_000001.10, NC_000001.11 | CPT2 | 330 |
| Carnitine palmitoyltransferase II deficiency | 74315294 | APG03850 | C > T | 23992 | NC_000001.10, NC_000001.11 | CPT2 | 331 |
| Carnitine palmitoyltransferase II deficiency | 74315294 | APG05586 | C > T | 23992 | NC_000001.10, NC_000001.11 | CPT2 | 332 |
| Carnitine palmitoyltransferase II deficiency | 74315294 | APG08167, APG01604 | C > T | 23992 | NC_000001.10, NC_000001.11 | CPT2 | 333 |
| Dopamine beta hydroxylase deficiency | 74853476 | APG02874, APG03031, APG09208 | T > C | 16789 | NC_000009.11, NC_000009.12 | DBH | 334 |
| Congenital microcephaly | 11555217 | APG06622 | C > T | 34125 | NC_000011.9, NC_000011.10 | DHCR7 | 335 |
| Smith-Lemli-Opitz syndrome | 80338853 | APG06622 | G > A | 21822 | NC_000011.9, NC_000011.10 | DHCR7 | 336 |

TABLE 11-continued

Disease Targets for RGNs

| Disease | RS# | RGN | CasI Mut. | Allele ID | Chromosome Accession | Gene Symbol | Target (SEQ ID NO.) |
|---|---|---|---|---|---|---|---|
| Smith-Lemli-Opitz syndrome | 80338857 | APG02874, APG03031, APG09208 | G > A | 34128 | NC_000011.9, NC_000011.10 | DHCR7 | 337 |
| Smith-Lemli-Opitz syndrome | 11555217 | APG06007 | G > A | 34125 | NC_000011.9, NC_000011.10 | DHCR7 | 338 |
| Smith-Lemli-Opitz syndrome | 11555217 | APG03850 | G > A | 34125 | NC_000011.9, NC_000011.10 | DHCR7 | 339 |
| Smith-Lemli-Opitz syndrome | 11555217 | APG05586 | G > A | 34125 | NC_000011.9, NC_000011.10 | DHCR7 | 340 |
| Familial dysautonomia | 1.11E+08 | APG06248 | A > G | 21124 | NC_000009.11, NC_000009.12 | ELP1 | 341 |
| Hypertyrosinemia | 80338901 | APG06622 | G > A | 26909 | NC_000015.9, NC_000015.10 | FAH | 342 |
| Hypertyrosinemia | 80338901 | APG06248 | G > A | 26909 | NC_000015.9, NC_000015.10 | FAH | 343 |
| Fanconi anemia | 1.05E+08 | APG06622 | G > A | 27086 | NC_000009.11, NC_000009.12 | FANCC | 344 |
| Marfan Syndrome | 3.98E+08 | APG06622 | C > T | 51454 | NC_000015.9, NC_000015.10 | FBN1 | 345 |
| Marfan Syndrome | 7.28E+08 | APG06622 | A > G | 175979 | NC_000015.9, NC_000015.10 | FBN1 | 346 |
| Marfan Syndrome | 1.38E+08 | APG02874, APG03031, APG09208 | G > A | 31496 | NC_000015.9, NC_000015.10 | FBN1 | 347 |
| Marfan Syndrome | 1.38E+08 | APG02874, APG03031, APG09208 | G > A | 31496 | NC_000015.9, NC_000015.10 | FBN1 | 348 |
| Marfan Syndrome | 3.88E+08 | APG02874, APG03031, APG09208 | G > A | 38652 | NC_000015.9, NC_000015.10 | FBN1 | 349 |
| FGFR3-Related Disorders | 1.22E+08 | APG06622 | C > T | 31371 | NC_000004.11, NC_000004.12 | FGFR3 | 350 |
| Glycogen storage disease type 1A | 1801175 | APG08167, APG01604 | C > T | 27037 | NC_000017.10, NC_000017.11 | G6PC | 351 |
| Glycogen storage disease, type II | 3.98E+08 | APG02874, APG03031, APG09208 | G > A | 415590 | NC_000017.10, NC_000017.11 | GAA | 352 |
| Deficiency of UDPglucose-hexose-1-phosphate uridylyltransferase | 75391579 | APG06622 | A > G | 18653 | NC_000009.11, NC_000009.12 | GALT | 353 |
| Glutaric aciduria, type 1 | 1.21E+08 | APG02874, APG03031, APG09208 | G > A | 17127 | NC_000019.9, NC_000019.10 | GCDH | 354 |
| Deafness, X-linked | 76434661 | APG06622 | C > T | 53916 | NC_000013.10, NC_000013.11 | GJB2 | 355 |
| Deafness, X-linked | 80338945 | APG06622 | A > G | 32055 | NC_000013.10, NC_000013.11 | GJB2 | 356 |
| Deafness, X-linked | 80338945 | APG02874, APG03031, APG09208 | T > C | 32055 | NC_000013.10, NC_000013.11 | GJB2 | 357 |
| Deafness, X-linked | 80338945 | APG02874, APG03031, APG09208 | T > C | 32055 | NC_000013.10, NC_000013.11 | GJB2 | 358 |
| Deafness, X-linked | 1.11E+08 | APG02874, APG03031, APG09208 | G > A | 53902 | NC_000013.10, NC_000013.11 | GJB2 | 359 |
| Deafness, X-linked | 1.05E+08 | APG06007 | G > A | 32041 | NC_000013.10, NC_000013.11 | GJB2 | 360 |
| Deafness, X-linked | 1.05E+08 | APG03850 | G > A | 32041 | NC_000013.10, NC_000013.11 | GJB2 | 361 |
| Deafness, X-linked | 1.05E+08 | APG08167, APG01604 | C > T | 32041 | NC_000013.10, NC_000013.11 | GJB2 | 362 |
| Deafness, X-linked | 80338945 | APG08167, APG01604 | A > G | 32055 | NC_000013.10, NC_000013.11 | GJB2 | 363 |
| Inclusion body myopathy 2 | 28937594 | APG06622 | A > G | 21064 | NC_000009.11, NC_000009.12 | GNE | 364 |
| Inclusion body myopathy 2 | 28937594 | APG06248 | A > G | 21064 | NC_000009.11, NC_000009.12 | GNE | 365 |
| beta Thalassemia | 33930165 | APG02874, APG03031, APG09208 | G > A | 30165 | NC_000011.9, NC_000011.10 | HBB | 366 |
| Mucopolysaccharidosis type I | 1.22E+08 | APG06622 | G > A | 26947 | NC_000004.11, NC_000004.12 | IDUA | 367 |
| Mucopolysaccharidosis type I | 1.22E+08 | APG06622 | C > T | 26948 | NC_000004.11, NC_000004.12 | IDUA | 368 |
| Mucopolysaccharidosis type I | 1.22E+08 | APG02874, APG03031, APG09208 | G > A | 26947 | NC_000004.11, NC_000004.12 | IDUA | 369 |
| Congenital long QT syndrome | 1.99E+08 | APG02874, APG03031, APG09208 | G > A | 67758 | NC_000011.9, NC_000011.10 | KCNQ1 | 370 |
| Congenital long QT syndrome | 1.99E+08 | APG02874, APG03031, APG09208 | T > C | 67776 | NC_000011.9, NC_000011.10 | KCNQ1 | 371 |
| Familial hypercholesterolemia | 28942080 | APG06622 | G > A | 18735 | NC_000019.9, NC_000019.10 | LDLR | 372 |

TABLE 11-continued

Disease Targets for RGNs

| Disease | RS# | RGN | Cas1 Mut. | Allele ID | Chromosome Accession | Gene Symbol | Target (SEQ ID NO.) |
|---|---|---|---|---|---|---|---|
| Familial hypercholesterolemia | 1.22E+08 | APG06622 | C > T | 18725 | NC_000019.9, NC_000019.10 | LDLR | 373 |
| Familial hypercholesterolemia | 1.38E+08 | APG06622 | G > A | 171217 | NC_000019.9, NC_000019.10 | LDLR | 374 |
| Familial hypercholesterolemia | 7.46E+08 | APG06622 | C > T | 228192 | NC_000019.9, NC_000019.10 | LDLR | 375 |
| Familial hypercholesterolemia | 7.66E+08 | APG06622 | G > A | 228162 | NC_000019.10, NC_000019.9 | LDLR | 376 |
| Familial hypercholesterolemia | 7.69E+08 | APG06622 | G > A | 228176 | NC_000019.10, NC_000019.9 | LDLR | 377 |
| Familial hypercholesterolemia | 7.46E+08 | APG06248 | C > T | 228192 | NC_000019.9, NC_000019.10 | LDLR | 378 |
| Familial hypercholesterolemia | 7.69E+08 | APG06248 | G > A | 228176 | NC_000019.10, NC_000019.9 | LDLR | 379 |
| Familial hypercholesterolemia | 3.76E+08 | APG02874, APG03031, APG09208 | G > A | 198012 | NC_000019.10, NC_000019.9 | LDLR | 380 |
| Familial hypercholesterolemia | 7.69E+08 | APG02874, APG03031, APG09208 | G > A | 228176 | NC_000019.10, NC_000019.9 | LDLR | 381 |
| Familial hypercholesterolemia | 7.75E+08 | APG02874, APG03031, APG09208 | T > C | 228197 | NC_000019.9, NC_000019.10 | LDLR | 382 |
| Familial hypercholesterolemia | 7.76E+08 | APG02874, APG03031, APG09208 | G > A | 246116 | NC_000019.9, NC_000019.10 | LDLR | 383 |
| Familial hypercholesterolemia | 8.79E+08 | APG02874, APG03031, APG09208 | T > C | 246008 | NC_000019.10, NC_000019.9 | LDLR | 384 |
| Familial hypercholesterolemia | 1.38E+08 | APG02787 | G > A | 171217 | NC_000019.9, NC_000019.10 | LDLR | 385 |
| Familial hypercholesterolemia | 1.38E+08 | APG06007 | G > A | 171217 | NC_000019.9, NC_000019.10 | LDLR | 386 |
| Familial hypercholesterolemia | 1.38E+08 | APG03850 | G > A | 171217 | NC_000019.9, NC_000019.10 | LDLR | 387 |
| Familial hypercholesterolemia | 1.38E+08 | APG05586 | G > A | 171217 | NC_000019.9, NC_000019.10 | LDLR | 388 |
| Familial hypercholesterolemia | 1.38E+08 | APG08167, APG01604 | G > A | 171217 | NC_000019.9, NC_000019.10 | LDLR | 389 |
| Familial hypercholesterolemia | 1.22E+08 | APG08167, APG01604 | C > T | 18725 | NC_000019.9, NC_000019.10 | LDLR | 390 |
| Cardio-facio-cutaneous syndrome | 1.22E+08 | APG06622 | A > G | 28390 | NC_000015.9, NC_000015.10 | MAP2K1 | 391 |
| MECP2-Related Disorders | 28934906 | APG06622 | G > A | 26850 | NC_000023.10, NC_000023.11 | MECP2 | 392 |
| MECP2-Related Disorders | 28935468 | APG06622 | G > A | 26863 | NC_000023.10, NC_000023.11 | MECP2 | 393 |
| MECP2-Related Disorders | 61749721 | APG06622 | G > A | 26868 | NC_000023.10, NC_000023.11 | MECP2 | 394 |
| MECP2-Related Disorders | 61750240 | APG06622 | G > A | 26854 | NC_000023.10, NC_000023.11 | MECP2 | 395 |
| MECP2-Related Disorders | 28935468 | APG06248 | G > A | 26863 | NC_000023.10, NC_000023.11 | MECP2 | 396 |
| MECP2-Related Disorders | 28934906 | APG06007 | C > T | 26850 | NC_000023.10, NC_000023.11 | MECP2 | 397 |
| MECP2-Related Disorders | 28934906 | APG03850 | C > T | 26850 | NC_000023.10, NC_000023.11 | MECP2 | 398 |
| MECP2-Related Disorders | 61750240 | APG02787 | C > T | 26854 | NC_000023.10, NC_000023.11 | MECP2 | 399 |
| MECP2-Related Disorders | 61750240 | APG06007 | C > T | 26854 | NC_000023.10, NC_000023.11 | MECP2 | 400 |
| MECP2-Related Disorders | 61750240 | APG03850 | C > T | 26854 | NC_000023.10, NC_000023.11 | MECP2 | 401 |
| MECP2-Related Disorders | 61750240 | APG05586 | C > T | 26854 | NC_000023.10, NC_000023.11 | MECP2 | 402 |
| Angelman syndrome | 61751362 | APG02787 | C > T | 26858 | NC_000023.10, NC_000023.11 | MECP2 | 403 |
| Angelman syndrome | 61751362 | APG06007 | C > T | 26858 | NC_000023.10, NC_000023.11 | MECP2 | 404 |
| Angelman syndrome | 61751362 | APG03850 | C > T | 26858 | NC_000023.10, NC_000023.11 | MECP2 | 405 |
| Angelman syndrome | 61751362 | APG05586 | C > T | 26858 | NC_000023.10, NC_000023.11 | MECP2 | 406 |
| Angelman syndrome | 28934906 | APG08167, APG01604 | G > A | 26850 | NC_000023.10, NC_000023.11 | MECP2 | 407 |
| Familial Mediterranean fever | 28940579 | APG06622 | A > G | 17579 | NC_000016.9, NC_000016.10 | MEFV | 408 |
| Familial Mediterranean fever | 61752717 | APG06622 | T > C | 17577 | NC_000016.9, NC_000016.10 | MEFV | 409 |
| Familial Mediterranean fever | 1.05E+08 | APG06622 | C > T | 17588 | NC_000016.9, NC_000016.10 | MEFV | 410 |
| Familial Mediterranean fever | 61752717 | APG06248 | T > C | 17577 | NC_000016.9, NC_000016.10 | MEFV | 411 |
| Familial Mediterranean fever | 1.05E+08 | APG06248 | C > T | 17588 | NC_000016.9, NC_000016.10 | MEFV | 412 |
| Familial Mediterranean fever | 1.05E+08 | APG02874, APG03031, APG09208 | G > A | 17588 | NC_000016.9, NC_000016.10 | MEFV | 413 |

TABLE 11-continued

Disease Targets for RGNs

| Disease | RS# | RGN | Cas1 Mut. | Allele ID | Chromosome Accession | Gene Symbol | Target (SEQ ID NO.) |
|---|---|---|---|---|---|---|---|
| Familial Mediterranean fever | 28940579 | APG08167, APG01604 | A > G | 17579 | NC_000016.9, NC_000016.10 | MEFV | 414 |
| Charcot-Marie-Tooth disease, type 2 | 28940293 | APG02874, APG03031, APG09208 | T > C | 17309 | NC_000001.10, NC_000001.11 | MFN2 | 415 |
| Hereditary nonpolyposis colon cancer | 63751657 | APG02874, APG03031, APG09208 | G > A | 95331 | NC_000003.11, NC_000003.12 | MLH1 | 416 |
| Hereditary nonpolyposis colon cancer | 63751711 | APG02874, APG03031, APG09208 | G > A | 95792 | NC_000003.11, NC_000003.12 | MLH1 | 417 |
| Methylmalonic acidemia | 1.22E+08 | APG06622 | C > T | 16462 | NC_000001.10, NC_000001.11 | MMACHC | 418 |
| Methylmalonic acidemia | 1.22E+08 | APG06248 | C > T | 16462 | NC_000001.10, NC_000001.11 | MMACHC | 419 |
| Methylmalonic acidemia | 1.22E+08 | APG02874, APG03031, APG09208 | G > A | 16464 | NC_000001.10, NC_000001.11 | MMACHC | 420 |
| Hereditary cancer-predisposing syndrome | 63750636 | APG06622 | C > T | 96378 | NC_000002.11, NC_000002.12 | MSH2 | 421 |
| Hereditary cancer-predisposing syndrome | 63749843 | APG06622 | C > T | 94826 | NC_000002.11, NC_000002.12 | MSH6 | 422 |
| Hereditary cancer-predisposing syndrome | 7.86E+08 | APG06622 | C > T | 181998 | NC_000002.12, NC_000002.11 | MSH6 | 423 |
| Hereditary cancer-predisposing syndrome | 63750741 | APG02874, APG03031, APG09208 | T > C | 94663 | NC_000002.11, NC_000002.12 | MSH6 | 424 |
| Hereditary cancer-predisposing syndrome | 63749843 | APG02787 | C > T | 94826 | NC_000002.11, NC_000002.12 | MSH6 | 425 |
| Hereditary cancer-predisposing syndrome | 63749843 | APG06007 | C > T | 94826 | NC_000002.11, NC_000002.12 | MSH6 | 426 |
| Hereditary cancer-predisposing syndrome | 63749843 | APG03850 | C > T | 94826 | NC_000002.11, NC_000002.12 | MSH6 | 427 |
| Hereditary cancer-predisposing syndrome | 63749843 | APG05586 | C > T | 94826 | NC_000002.11, NC_000002.12 | MSH6 | 428 |
| Hereditary cancer-predisposing syndrome | 63751017 | APG02787 | C > T | 94786 | NC_000002.11, NC_000002.12 | MSH6 | 429 |
| Hereditary cancer-predisposing syndrome | 63751017 | APG06007 | C > T | 94786 | NC_000002.11, NC_000002.12 | MSH6 | 430 |
| Hereditary cancer-predisposing syndrome | 63751017 | APG03850 | C > T | 94786 | NC_000002.11, NC_000002.12 | MSH6 | 431 |
| Hereditary cancer-predisposing syndrome | 63751017 | APG05586 | C > T | 94786 | NC_000002.11, NC_000002.12 | MSH6 | 432 |
| Hereditary cancer-predisposing syndrome | 63751017 | APG08167, APG01604 | C > T | 94786 | NC_000002.11, NC_000002.12 | MSH6 | 433 |
| MUTYH-associated polyposis | 34612342 | APG06622 | T > C | 20332 | NC_000001.10, NC_000001.11 | MUTYH | 434 |
| MUTYH-associated polyposis | 36053993 | APG06622 | C > T | 20333 | NC_000001.10, NC_000001.11 | MUTYH | 435 |
| MUTYH-associated polyposis | 36053993 | APG02787 | G > A | 20333 | NC_000001.10, NC_000001.11 | MUTYH | 436 |
| MUTYH-associated polyposis | 36053993 | APG06007 | G > A | 20333 | NC_000001.10, NC_000001.11 | MUTYH | 437 |
| MUTYH-associated polyposis | 36053993 | APG03850 | G > A | 20333 | NC_000001.10, NC_000001.11 | MUTYH | 438 |
| MUTYH-associated polyposis | 36053993 | APG05586 | G > A | 20333 | NC_000001.10, NC_000001.11 | MUTYH | 439 |
| MUTYH-associated polyposis | 36053993 | APG08167, APG01604 | C > T | 20333 | NC_000001.10, NC_000001.11 | MUTYH | 440 |
| MUTYH-associated polyposis | 34612342 | APG08167, APG01604 | T > C | 20332 | NC_000001.10, NC_000001.11 | MUTYH | 441 |
| Hyperimmunoglobulin D with periodic fever | 28934897 | APG06622 | G > A | 26968 | NC_000012.11, NC_000012.12 | MVK | 442 |
| MYBPC3-Related Disorders | 2E+08 | APG06622 | C > T | 174776 | NC_000011.9, NC_000011.10 | MYBPC3 | 443 |
| MYBPC3-Related Disorders | 3.88E+08 | APG06622 | G > A | 45725 | NC_000011.9, NC_000011.10 | MYBPC3 | 444 |
| MYBPC3-Related Disorders | 3.98E+08 | APG06622 | C > T | 51962 | NC_000011.9, NC_000011.10 | MYBPC3 | 445 |
| MYBPC3-Related Disorders | 2E+08 | APG06248 | C > T | 174776 | NC_000011.9, NC_000011.10 | MYBPC3 | 446 |
| MYBPC3-Related Disorders | 1.88E+08 | APG02874, APG03031, APG09208 | T > C | 45267 | NC_000011.9, NC_000011.10 | MYBPC3 | 447 |

TABLE 11-continued

Disease Targets for RGNs

| Disease | RS# | RGN | Cas1 Mut. | Allele ID | Chromosome Accession | Gene Symbol | Target (SEQ ID NO.) |
|---|---|---|---|---|---|---|---|
| MYBPC3-Related Disorders | 2E+08 | APG02874, APG03031, APG09208 | G > A | 174776 | NC_000011.9, NC_000011.10 | MYBPC3 | 448 |
| MYBPC3-Related Disorders | 3.98E+08 | APG02874, APG03031, APG09208 | G > A | 51820 | NC_000011.9, NC_000011.10 | MYBPC3 | 449 |
| MYBPC3-Related Disorders | 3.98E+08 | APG02874, APG03031, APG09208 | G > A | 51962 | NC_000011.9, NC_000011.10 | MYBPC3 | 450 |
| Cardiomyopathy | 3218716 | APG06622 | C > T | 52071 | NC_000014.8, NC_000014.9 | MYH7 | 451 |
| Cardiomyopathy | 36211715 | APG06622 | C > T | 29159 | NC_000014.8, NC_000014.9 | MYH7 | 452 |
| Cardiomyopathy | 1.22E+08 | APG06622 | G > A | 29128 | NC_000014.8, NC_000014.9 | MYH7 | 453 |
| Cardiomyopathy | 3.72E+08 | APG06622 | C > T | 52045 | NC_000014.8, NC_000014.9 | MYH7 | 454 |
| Cardiomyopathy | 3.98E+08 | APG02874, APG03031, APG09208 | T > C | 52276 | NC_000014.8, NC_000014.9 | MYH7 | 455 |
| Cardiomyopathy | 3.72E+08 | APG06007 | G > A | 52045 | NC_000014.8, NC_000014.9 | MYH7 | 456 |
| Cardiomyopathy | 3.72E+08 | APG03850 | G > A | 52045 | NC_000014.8, NC_000014.9 | MYH7 | 457 |
| Deafness, autosomal recessive | 1.11E+08 | APG02874, APG03031, APG09208 | G > A | 52388 | NC_000011.9, NC_000011.10 | MYO7A | 458 |
| Inborn genetic diseases | 80358259 | APG06622 | A > G | 18006 | NC_000018.9, NC_000018.10 | NPC1 | 459 |
| Inborn genetic diseases | 80358259 | APG02874, APG03031, APG09208 | T > C | 18006 | NC_000018.9, NC_000018.10 | NPC1 | 460 |
| Inborn genetic diseases | 1.2E+08 | APG02874, APG03031, APG09208 | G > A | 18010 | NC_000018.9, NC_000018.10 | NPC1 | 461 |
| Phenylketonuria | 5030851 | APG06622 | G > A | 15628 | NC_000012.11, NC_000012.12 | PAH | 462 |
| Phenylketonuria | 5030858 | APG06622 | G > A | 15616 | NC_000012.11, NC_000012.12 | PAH | 463 |
| Hyperphenylalaninemia | 5030860 | APG06622 | T > C | 15632 | NC_000012.11, NC_000012.12 | PAH | 464 |
| Phenylketonuria | 62516101 | APG02874, APG03031, APG09208 | G > A | 15658 | NC_000012.11, NC_000012.12 | PAH | 465 |
| Hyperphenylalaninemia, non-pku | 62644499 | APG02874, APG03031, APG09208 | G > A | 15656 | NC_000012.11, NC_000012.12 | PAH | 466 |
| Phenylketonuria | 5030858 | APG02787 | C > T | 15616 | NC_000012.11, NC_000012.12 | PAH | 467 |
| Phenylketonuria | 5030858 | APG06007 | C > T | 15616 | NC_000012.11, NC_000012.12 | PAH | 468 |
| Phenylketonuria | 5030858 | APG03850 | C > T | 15616 | NC_000012.11, NC_000012.12 | PAH | 469 |
| Phenylketonuria | 5030858 | APG05586 | C > T | 15616 | NC_000012.11, NC_000012.12 | PAH | 470 |
| Hyperphenylalaninemia, non-pku | 5030860 | APG08167, APG01604 | T > C | 15632 | NC_000012.11, NC_000012.12 | PAH | 471 |
| Hyperphenylalaninemia, non-pku | 62642937 | APG08167, APG01604 | G > A | 15667 | NC_000012.11, NC_000012.12 | PAH | 472 |
| Familial cancer of breast | 1.8E+08 | APG06622 | G > A | 132139 | NC_000016.10, NC_000016.9 | PALB2 | 473 |
| Familial cancer of breast | 1.8E+08 | APG02874, APG03031, APG09208 | G > A | 132185 | NC_000016.10, NC_000016.9 | PALB2 | 474 |
| Peroxisome biogenesis disorder 1B | 61750420 | APG08167, APG01604 | C > T | 22555 | NC_000007.13, NC_000007.14 | PEX1 | 475 |
| Immunodeficiency 14 | 3.98E+08 | APG06622 | G > A | 94255 | NC_000001.10, NC_000001.11 | PIK3CD | 476 |
| Polycystic kidney dysplasia | 1.38E+08 | APG06622 | G > A | 19147 | NC_000006.11, NC_000006.12 | PKHD1 | 477 |
| Carbohydrate-deficient glycoprotein syndrome type I | 28936415 | APG02787 | G > A | 22745 | NC_000016.9, NC_000016.10 | PMM2 | 478 |
| Carbohydrate-deficient glycoprotein syndrome type I | 28936415 | APG06007 | G > A | 22745 | NC_000016.9, NC_000016.10 | PMM2 | 479 |
| Carbohydrate-deficient glycoprotein syndrome type I | 28936415 | APG03850 | G > A | 22745 | NC_000016.9, NC_000016.10 | PMM2 | 480 |
| Carbohydrate-deficient glycoprotein syndrome type I | 28936415 | APG05586 | G > A | 22745 | NC_000016.9, NC_000016.10 | PMM2 | 481 |
| Carbohydrate-deficient glycoprotein syndrome type I | 28936415 | APG08167, APG01604 | G > A | 22745 | NC_000016.9, NC_000016.10 | PMM2 | 482 |
| POLG-related condition | 1.14E+08 | APG06622 | C > T | 28535 | NC_000015.9, NC_000015.10 | POLG | 483 |
| POLG-related condition | 1.14E+08 | APG06622 | C > T | 28541 | NC_000015.9, NC_000015.10 | POLG | 484 |
| POLG-related condition | 1.14E+08 | APG02874, APG03031, APG09208 | G > A | 28535 | NC_000015.9, NC_000015.10 | POLG | 485 |

TABLE 11-continued

Disease Targets for RGNs

| Disease | RS# | RGN | Cas1 Mut. | Allele ID | Chromosome Accession | Gene Symbol | Target (SEQ ID NO.) |
|---|---|---|---|---|---|---|---|
| POLG-related condition | 1.14E+08 | APG06007 | G > A | 28535 | NC_000015.9, NC_000015.10 | POLG | 486 |
| POLG-related condition | 1.14E+08 | APG03850 | G > A | 28535 | NC_000015.9, NC_000015.10 | POLG | 487 |
| POLG-related condition | 1.14E+08 | APG08167, APG01604 | C > T | 28541 | NC_000015.9, NC_000015.10 | POLG | 488 |
| Ceroid lipofuscinosis neuronal 1 | 1.38E+08 | APG06622 | G > A | 23943 | NC_000001.10, NC_000001.11 | PPT1 | 489 |
| Ceroid lipofuscinosis neuronal 1 | 1.38E+08 | APG02787 | C > T | 23943 | NC_000001.10, NC_000001.11 | PPT1 | 490 |
| Ceroid lipofuscinosis neuronal 1 | 1.38E+08 | APG06007 | C > T | 23943 | NC_000001.10, NC_000001.11 | PPT1 | 491 |
| Ceroid lipofuscinosis neuronal 1 | 1.38E+08 | APG03850 | C > T | 23943 | NC_000001.10, NC_000001.11 | PPT1 | 492 |
| Ceroid lipofuscinosis neuronal 1 | 1.38E+08 | APG05586 | C > T | 23943 | NC_000001.10, NC_000001.11 | PPT1 | 493 |
| Ceroid lipofuscinosis neuronal 1 | 1.38E+08 | APG08167, APG01604 | G > A | 23943 | NC_000001.10, NC_000001.11 | PPT1 | 494 |
| Cardiomyopathy | 1.22E+08 | APG06622 | C > T | 21885 | NC_000007.13, NC_000007.14 | PRKAG2 | 495 |
| Cowden syndrome | 1.22E+08 | APG06622 | C > T | 22852 | NC_000010.10, NC_000010.11 | PTEN | 496 |
| PTPN11-related disorder | 1.22E+08 | APG06622 | C > T | 28370 | NC_000012.11, NC_000012.12 | PTPN11 | 497 |
| B lymphoblastic leukemia lymphoma, no ICD-O subtype | 1.22E+08 | APG06622 | A > G | 28372 | NC_000012.11, NC_000012.12 | PTPN11 | 498 |
| PTPN11-related disorder | 3.98E+08 | APG06622 | A > G | 49032 | NC_000012.11, NC_000012.12 | PTPN11 | 499 |
| PTPN11-related disorder | 1.22E+08 | APG06248 | C > T | 28370 | NC_000012.11, NC_000012.12 | PTPN11 | 500 |
| PTPN11-related disorder | 1.22E+08 | APG06248 | A > G | 28379 | NC_000012.11, NC_000012.12 | PTPN11 | 501 |
| PTPN11-related disorder | 28933386 | APG02787 | A > G | 28365 | NC_000012.11, NC_000012.12 | PTPN11 | 502 |
| PTPN11-related disorder | 28933386 | APG06007 | A > G | 28365 | NC_000012.11, NC_000012.12 | PTPN11 | 503 |
| PTPN11-related disorder | 28933386 | APG03850 | A > G | 28365 | NC_000012.11, NC_000012.12 | PTPN11 | 504 |
| PTPN11-related disorder | 28933386 | APG05586 | A > G | 28365 | NC_000012.11, NC_000012.12 | PTPN11 | 505 |
| PTPN11-related disorder | 1.22E+08 | APG02787 | A > G | 28372 | NC_000012.11, NC_000012.12 | PTPN11 | 506 |
| PTPN11-related disorder | 1.22E+08 | APG06007 | A > G | 28372 | NC_000012.11, NC_000012.12 | PTPN11 | 507 |
| PTPN11-related disorder | 1.22E+08 | APG03850 | A > G | 28372 | NC_000012.11, NC_000012.12 | PTPN11 | 508 |
| PTPN11-related disorder | 1.22E+08 | APG05586 | A > G | 28372 | NC_000012.11, NC_000012.12 | PTPN11 | 509 |
| PTPN11-related disorder | 28933386 | APG08167, APG01604 | A > G | 28365 | NC_000012.11, NC_000012.12 | PTPN11 | 510 |
| Glycogen storage disease | 1.17E+08 | APG06622 | G > A | 17337 | NC_000011.9, NC_000011.10 | PYGM | 511 |
| Glycogen storage disease | 1.17E+08 | APG06248 | G > A | 17337 | NC_000011.9, NC_000011.10 | PYGM | 512 |
| Breast-ovarian cancer, familial 4 | 3.88E+08 | APG06622 | G > A | 39241 | NC_000017.10, NC_000017.11 | RAD51D | 513 |
| Dilated cardiomyopathy 1DD | 2.68E+08 | APG02874, APG03031, APG09208 | G > A | 15310 | NC_000010.10, NC_000010.11 | RBM20 | 514 |
| RET-Related Disorders | 74799832 | APG06622 | T > C | 28958 | NC_000010.10, NC_000010.11 | RET | 515 |
| RET-Related Disorders | 74799832 | APG02874, APG03031, APG09208 | T > C | 28958 | NC_000010.10, NC_000010.11 | RET | 516 |
| RYR1-Related Disorders | 1.18E+08 | APG06622 | C > T | 28003 | NC_000019.9, NC_000019.10 | RYR1 | 517 |
| RYR1-Related Disorders | 2.01E+08 | APG06622 | C > T | 169564 | NC_000019.9, NC_000019.10 | RYR1 | 518 |
| RYR1-Related Disorders | 1.18E+08 | APG02874, APG03031, APG09208 | G > A | 76888 | NC_000019.9, NC_000019.10 | RYR1 | 519 |
| RYR1-Related Disorders | 1.18E+08 | APG02874, APG03031, APG09208 | G > A | 76888 | NC_000019.9, NC_000019.10 | RYR1 | 520 |
| RYR1-Related Disorders | 1.18E+08 | APG02874, APG03031, APG09208 | G > A | 76835 | NC_000019.9, NC_000019.10 | RYR1 | 521 |
| RYR1-Related Disorders | 1.18E+08 | APG02874, APG03031, APG09208 | T > C | 28014 | NC_000019.9, NC_000019.10 | RYR1 | 522 |
| Shwachman syndrome | 1.14E+08 | APG06622 | A > G | 18235 | NC_000007.13, NC_000007.14 | SBDS | 523 |
| Brugada syndrome | 1.38E+08 | APG06622 | C > T | 24416 | NC_000003.11, NC_000003.12 | SCN5A | 524 |
| Brugada syndrome | 28937316 | APG02874, APG03031, APG09208 | G > A | 24408 | NC_000003.11, NC_000003.12 | SCN5A | 525 |
| Brugada syndrome | 45546039 | APG02874, APG03031, APG09208 | G > A | 48043 | NC_000003.11, NC_000003.12 | SCN5A | 526 |
| Brugada syndrome | 72549410 | APG02874, APG03031, APG09208 | G > A | 78547 | NC_000003.11, NC_000003.12 | SCN5A | 527 |
| Cowden syndrome 3 | 80338844 | APG06622 | C > T | 21935 | NC_000011.9, NC_000011.10 | SDHD | 528 |
| Cowden syndrome 3 | 80338844 | APG06248 | C > T | 21935 | NC_000011.9, NC_000011.10 | SDHD | 529 |

TABLE 11-continued

Disease Targets for RGNs

| Disease | RS# | RGN | Cas1 Mut. | Allele ID | Chromosome Accession | Gene Symbol | Target (SEQ ID NO.) |
|---|---|---|---|---|---|---|---|
| Alpha-1-antitrypsin deficiency | 28929474 | APG06622 | C > T | 33006 | NC_000014.8, NC_000014.9 | SERPINA1 | 530 |
| Alpha-1-antitrypsin deficiency | 28929474 | APG02787 | G > A | 33006 | NC_000014.8, NC_000014.9 | SERPINA1 | 531 |
| Alpha-1-antitrypsin deficiency | 28929474 | APG03850 | G > A | 33006 | NC_000014.8, NC_000014.9 | SERPINA1 | 532 |
| Alpha-1-antitrypsin deficiency | 28929474 | APG05586 | G > A | 33006 | NC_000014.8, NC_000014.9 | SERPINA1 | 533 |
| Alpha-1-antitrypsin deficiency | 28929474 | APG08167, APG01604 | C > T | 33006 | NC_000014.8, NC_000014.9 | SERPINA1 | 534 |
| Limb-girdle muscular dystrophy, type 2D | 28933693 | APG06622 | C > T | 24476 | NC_000017.10, NC_000017.11 | SGCA | 535 |
| Mucopolysaccharidosis, MPS-III-A | 1.05E+08 | APG06622 | C > T | 20146 | NC_000017.10, NC_000017.11 | SGSH | 536 |
| Mucopolysaccharidosis, MPS-III-A | 1.05E+08 | APG02874, APG03031, APG09208 | G > A | 20146 | NC_000017.10, NC_000017.11 | SGSH | 537 |
| Noonan syndrome | 2.68E+08 | APG02787 | A > G | 21860 | NC_000010.10, NC_000010.11 | SHOC2 | 538 |
| Noonan syndrome | 2.68E+08 | APG06007 | A > G | 21860 | NC_000010.10, NC_000010.11 | SHOC2 | 539 |
| Noonan syndrome | 2.68E+08 | APG03850 | A > G | 21860 | NC_000010.10, NC_000010.11 | SHOC2 | 540 |
| Noonan syndrome | 2.68E+08 | APG05586 | A > G | 21860 | NC_000010.10, NC_000010.11 | SHOC2 | 541 |
| Noonan syndrome | 2.68E+08 | APG08167, APG01604 | A > G | 21860 | NC_000010.10, NC_000010.11 | SHOC2 | 542 |
| SLC26A2-Related Disorders | 1.05E+08 | APG06622 | C > T | 19128 | NC_000005.9, NC_000005.10 | SLC26A2 | 543 |
| SLC26A2-Related Disorders | 1.11E+08 | APG02874, APG03031, APG09208 | G > A | 52666 | NC_000007.13, NC_000007.14 | SLC26A4 | 544 |
| Familial hypertrophic cardiomyopathy 2 | 7.28E+08 | APG02874, APG03031, APG09208 | G > A | 172354 | NC_000001.10, NC_000001.11 | TNNT2 | 545 |
| Charcot-Marie-Tooth disease type 2C | 3.98E+08 | APG02874, APG03031, APG09208 | G > A | 48018 | NC_000012.11, NC_000012.12 | TRPV4 | 546 |
| Focal cortical dysplasia type II | 28934872 | APG06622 | G > A | 27436 | NC_000016.9, NC_000016.10 | TSC2 | 547 |
| Amyloidogenic transthyretin amyloidosis | 76992529 | APG06622 | G > A | 28465 | NC_000018.9, NC_000018.10 | TTR | 548 |
| Amyloidogenic transthyretin amyloidosis | 76992529 | APG06248 | G > A | 28465 | NC_000018.9, NC_000018.10 | TTR | 549 |
| Oculocutaneous albinism | 1.05E+08 | APG06622 | C > T | 18816 | NC_000011.9, NC_000011.10 | TYR | 550 |
| Oculocutaneous albinism | 1.22E+08 | APG02874, APG03031, APG09208 | G > A | 18814 | NC_000011.9, NC_000011.10 | TYR | 551 |
| Von Willebrand disease | 41276738 | APG06622 | C > T | 15335 | NC_000012.11, NC_000012.12 | VWF | 552 |

Example 7: Targeting Mutations Responsible for Hurler Syndrome

The following describes a potential treatment for Hurler Syndrome, also referred to as MPS-1, using an RNA directed base editing system that corrects a mutation responsible for Hurler syndrome in a large proportion of patients with the disease. This approach utilizes a base editing fusion protein that is RNA guided and that can be packaged into a single AAV vector for delivery to a wide range of tissue types. Depending on the exact regulatory elements and base editor domain used, it may also be possible to engineer a single vector that encodes for both the base editing fusion protein and a single guide RNA to target the diseased locus.

Example 7.1: Identifying RGN with Ideal PAM

The genetic disease MPS-1 is a lysosomal storage disease characterized at the molecular level by the accumulation of dermatan sulfate and heparan sulfate in lysosomes. This disease is generally an inherited genetic disorder caused by mutations in the IDUA gene (NCBI Reference sequence NG_008103.1), which encodes α-L-iduronidase. The disease is a result of a deficiency of α-L-iduronidase. The most common IDUA mutations found in studies of individuals of Northern European background are W402X and Q70X, both nonsense mutations resulting in premature termination of translation (Bunge et al. (1994), Hum. Mol. Genet, 3(6): 861-866, herein incorporated by reference). Reversion of a single nucleotide would restore the wild-type coding sequence and result in protein expression controlled by the endogenous regulatory mechanisms of the genetic locus.

The W402X mutation of the human Idua gene accounts for a high proportion of MPS-1H cases. Base editors can target a narrow sequence window relative to the binding site of the protospacer component of the guide RNA and thus the presence of a PAM sequence a specific distance from the target locus is essential for the success of the strategy. Given the constraints that the target mutation must be on the exposed non-target strand (NTS) during the interaction of the base editing protein and that the footprint of the RGN domain will block access to the region near the PAM, an accessible locus is thought to be 10-30 bp from the PAM. To avoid editing and mutagenesis of other nearby adenosine bases in this window, different linkers are screened. The ideal window is 12-16 bp from the PAM.

A PAM sequence compatible with APG02874, APG09208, and APG05586 is readily apparent at the genetic locus. These nucleases have a PAM sequence of 5'-nnnnCC-3' (SEQ ID NO: 35), 5'-nnnnC-3' (SEQ ID NO: 62) and 5'-nnRYA-3' (SEQ ID NO: 69), respectively, and are compact in size—potentially allowing delivery via a single AAV vector. This delivery approach bestows multiple advantages relative to others, such as access to a wide range of tissues (liver, muscle, CNS) and well established safety profile and manufacturing techniques.

Cas9 from *S. pyogenes* (SpyCas9) requires a PAM sequence of NGG (SEQ ID NO: 256), which is present near the W402X locus, but the size of SpyCas9 prevents packaging into a single AAV vector, and thus forgoes the aforementioned advantages of this approach. While a dual delivery strategy may be employed (for example, Ryu et al, (2018), Nat. Biotechnol., 36(6): 536-539, herein incorporated by reference), it would add significant manufacturing complexity and cost. Additionally, dual viral vector delivery significantly decreases the efficiency of gene correction, since a successful edit in a given cell requires infection with both vectors and assembly of the fusion protein in the cell.

A commonly used Cas9 ortholog from *S. aureus* (Sau-Cas9) is considerably smaller in size relative to SpyCas9 but has a more complex PAM requirement—NGRRT (SEQ ID NO: 257). This sequence is not within a range expected to be useful for base editing of the causative locus.

Example 7.2: RGN Fusion Constructs and sgRNA Sequences

A DNA sequence encoding a fusion protein with the following domains is produced using standard molecular biology techniques: 1) an RGN domain with mutations that inactivate the DNA cleavage activity ("dead" or "nickase"); 2) an adenosine deaminase useful for base editing. All constructs described in the table below comprise a fusion protein with the base editing active domain, in this example ADAT (SEQ ID NO: 211), operably fused to the N-terminal end of the a dead RGN APG02874 (SEQ ID NO: 214), APG09208 (SEQ ID NO: 216), and APG005586 (SEQ ID NO: 567). Other adenosine deaminases useful for base editing DNA may also be used (see for example PCT application PCT/US2019/068079). It is known in the art that a fusion protein could also be made with the base-editing enzyme at the C-terminal end of the RGN. Additionally, the RGN and the base editor of the fusion protein are typically separated by a linker amino sequence. It is known in the art that lengths of standard linkers range from 15-30 amino acids. Further, it is known in the art that certain fusion proteins between an RGN and a base-editing enzyme may also comprise at least one uracil glycosylase inhibitor (UGI) domain (SEQ ID NO: 212), which may increase base editing efficiency (U.S. Pat. No. 10,167,457, herein incorporated by reference). Therefore, a fusion protein may comprise RGN APG02874, APG09208, or a variant thereof, an adenosine deaminase, and optionally at least one UGI.

TABLE 12

Constructs for RNA-targeted base editing

| SEQ ID NO. | Construct | RGN | Dead (D) or Nickase (N) | Base editor |
|---|---|---|---|---|
| 213 | Nuc-ADAT-Linker-d APG02874 - Linker-SV40 | APG02874 | D | ADAT |
| 215 | Nuc-ADAT-Linker-d APG09208- Linker-SV40 | APG09208 | D | ADAT |
| 565 | Nuc-ADAT-Linker-d APG05586- Linker-SV40 | APG05586 | D | ADAT |

The accessible editing sites of an RGN are determined by the PAM sequence. When combining an RGN with a base editing domain, the target residue for editing must reside on the non-target strand (NTS), since the NTS is single stranded while the RGN is associated with the locus. Evaluating a number of nucleases and corresponding guide RNAs enables the selection of the most appropriate gene editing tool for this particular locus. Several potential PAM sequences that can be targeted by the constructs described above in the human Idua gene are in the proximity of the mutant nucleotide responsible for the W402X mutation. A sequence encoding a guide RNA transcript containing 1) a "spacer" that is complementary to the non-coding DNA strand at the disease locus; and 2) RNA sequence required for association of the guide RNA with the RGN is also produced. Such a sgRNA may be encoded by, for example, SEQ ID NO: 217 for the APG02874 RGN system, SEQ ID NO: 218 for the APG09208 RGN system, or SEQ ID NO: 566 for the APG005586 RGN system. These sgRNA molecules, and similar sgRNAs that may be devised by one of skill in the art, can be evaluated for their efficiency in directing the base editors above to the locus of interest.

Example 7.3: Assay for Activity in Cells from Hurler Disease Patients

To verify the genotype strategy and evaluate the constructs described above, fibroblasts from Hurler disease patients are used. A vector is designed containing appropriate promoters upstream of the fusion protein coding sequence and the sgRNA encoding sequence for expression of these in human cells, similar to those vectors described in Example 4. It is recognized that promoters and other DNA elements (for example enhancers, or terminators) which either are known for high levels of expression in human cells or may specifically express well in fibroblast cells may also be used. The vector is transfected into the fibroblasts using standard techniques, for example transfection similar to what is described in Example 4. Alternatively, electroporation may be used. The cells are cultured for 1-3 days. Genomic DNA (gDNA) is isolated using standard techniques. The editing efficiency is determined by performing a qPCR genotyping assay and/or next generation sequencing on the purified gDNA, as described further below.

Taqman™ qPCR analysis utilizes probes specific for the wild-type and mutant allele. These probes bear fluorophores which are resolved by their spectral excitation and/or emission properties using a qPCR instrument. A genotyping kit containing PCR primers and probes can be obtained commercially (i.e. Thermo Fisher Taqman™ SNP genotyping assayID C_27862753_10 for SNP ID rs121965019) or designed. An example of a designed primer and probe set is shown in Table 13.

TABLE 13

RT-PCR primers and probes

| Description | Sequence | SEQ ID NO. |
|---|---|---|
| Forward Amplification Primer | 5'-GACTCCTTCACCAAG-3' | 219 |
| Reverse Amplification Primer | 5'-GTAGATCAGCACCG-3' | 220 |
| Wild Type Probe | 5'-CTCTGGGCCGAAGT-3' | 221 |
| W402X Probe | 5'-CTCTAGGCCGAAGT-3' | 222 |

Following the editing experiment, the gDNA is subjected to qPCR analysis using standard methods and the primers and probes described above. Expected results are shown in Table 14. This in vitro system can be used to expediently evaluate constructs and choose one with high editing efficiency for further studies. The systems will be evaluated in comparison with cells with and without the W402X mutation, and preferably with some that are heterozygous for this mutation. The Ct values will be compared to either a reference gene or the total amplification of the locus using a dye such as Sybr green.

TABLE 14

Expected qPCR results

| Genotype | Transfected with base editor | Expected PCR result |
|---|---|---|
| Idua$^{WT/WT}$ | No | Homozygous WT |
| Idua$^{WT/W402X}$ | No | Heterozygous: 50% WT, 50% W402X |
| Idua$^{W402X/W402X}$ | No | Homozygous W402X |
| Idua$^{W402X/W402X}$ | Yes | Variable |

The tissues can also be analyzed by next generation sequencing. Primer binding sites such as the ones shown below (Table 15), or other suitable primer binding sites that can be identified by a person of skill in the art, can be used. Following PCR amplification, products containing Illumina Nextera XT overhang sequences undergo library preparation following the Illumina 16S Metagenomic Sequencing Library protocol. Deep sequencing is performed on an Illumina Mi-Seq platform. Typically, 200,000 of 250 bp paired-end reads (2×100,000 reads) are generated per amplicon. The reads are analyzed using CRISPResso (Pinello et al., 2016) to calculate the rates of editing. Output alignments are hand-curated to confirm insertion and deletion sites as well as identify microhomology sites at the recombination sites.

TABLE 15

NGS primer binding sites

| Direction | Sequence | SEQ ID NO. |
|---|---|---|
| Forward | 5'-ACTTCCTCCAGCC-3' | 223 |
| Reverse | 5'-GAACCCCGGCTTA-3' | 224 |

Western blotting of cell lysate of transfected cells and control cells using an anti-IDUA antibody is performed to verify expression of the full-length protein and an enzyme activity assay on the cell lysate using substrate 4-methyl-umbelliferyl a-L-iduronide verifies that the enzyme is catalytically active (Hopwood et al., Clin. Chim. ACta (1979), 92(2): 257-265, incorporated by reference herein). These experiments are performed in comparison with the original Idua$^{W402X/W402X}$ cell line (without transfection), the Idua$^{W402X/W402X}$ cell line transfected with the base editing construct and a random guide sequence, and a cell line expressing wild-type IDUA.

Example 7.4: Disease Treatment Validation in a Murine Model

To verify the efficacy of this therapeutic approach, a mouse model with a nonsense mutation in the analogous amino acid is used. The mouse strain bears a W392X mutation in its Idua gene (Gene ID: 15932) which corresponds to the homologous mutation in Hurler syndrome patients (Bunge et al., (1994), Hum. Mol. Genet. 3(6): 861-866, incorporated by reference herein). This locus comprises a distinct nucleotide sequence relative to that in humans, which lacks the PAM sequence necessary for correction with the base editors described in the previous examples, and thus necessitates design of a distinct fusion protein to perform the nucleotide correction. Amelioration of the disease in this animal can validate the therapeutic approach of correcting the mutation in tissues accessible by a gene delivery vector.

Mice homozygous for this mutation display a number of phenotypic characteristics similar to Hurler syndrome patients. A base editing-RGN fusion protein as described above (Table 12) along with an RNA guide sequence are incorporated into an expression vector that allows protein expression and RNA transcription in mice. A study design is shown below in Table 16. The study includes groups that are treated with a high dose of the expression vector comprising the base-editing fusion protein and RNA guide sequence, a low dose of same expression vector, control which is the model mouse treated with an expression vector that does not comprise the base editing fusion protein or the guide RNA, and a second control which is a wild type mouse treated with the same empty vector.

TABLE 16

Genome editing experiment in murine model

| Group | Mouse strain | N | Treatment |
|---|---|---|---|
| 1 | Idua-W392X[1] | ≥5 | Low dose of vector |
| 2 | Idua-W392X | ≥5 | High dose of vector |
| 3 | Idua-W392X | ≥5 | Vehicle |
| 4 | 129/Sv (WT) | 5 | Vehicle |

Endpoints to evaluate include body weight, urine GAG excretion, serum IDUA enzymatic activity, IDUA activity in tissues of interest, tissue pathology, genotyping of tissues of interest to verify correction of the SNP, and behavioral and neurological evaluation. Since some endpoints are terminal, additional groups may be added for evaluation of, for example, tissue pathology and tissue IDUA activities before the end of the study. Additional examples of endpoints can be found in published papers establishing Hurler syndrome animal models (Shull et al. (1994), Proc. Natl. Acad. Sci. U.S.A., 91(26): 12937-12941; Wang et al. (2010), Mol. Genet. Metab., 99(1): 62-71; Hartung et al. (2004), Mol. Ther., 9(6): 866-875; Liu et al. (2005), Mol. Ther., 11(1): 35-47; Clarke et al. (1997), Hum. Mol. Genet. 6(4): 503-511; all herein incorporated by reference).

One possible delivery vector utilizes the adeno associated virus (AAV). A vector is produced to include a base editor-dRGN fusion protein coding sequence (for example, Nuc-ADAT-Linker-dAPG19748-Linker-SV40, as described above) preceded by a CMV enhancer (SEQ ID NO: 259) and promoter (SEQ ID NO: 258), or other suitable enhancer and promoter combination), optionally a Kozak sequence, and operably fused at the 3' end to a terminator sequence and a poly-adenylation sequence such as the minimal sequence described in Levitt, N.; Briggs, D.; Gil, A.; Proudfoot, N. J. Definition of an Efficient Synthetic Poly(A) Site. Genes Dev. 1989, 3 (7), 1019-1025. The vector may further comprise an expression cassette encoding for a single guide RNA operably linked at its 5' end to a human U6 promoter (SEQ ID NO: 260) or another promoter suitable for production of small non-coding RNAs, and further comprising inverted terminal repeat (ITR) sequences necessary and well-known in the art for packaging into the AAV capsid. Production and viral packaging is performed by standard methods, such as those described in U.S. Pat. No. 9,587,250, herein incorporated by reference.

Other possible viral vectors include adenovirus and lentivirus vectors, which are commonly used and would contain similar elements, with different packaging capabilities and requirements. Non-viral delivery methods also be used, such as mRNA and sgRNA encapsulated by lipid nanoparticles (Cullis, P. R. and Allen, T. M. (2013), Adv. Drug Deliv. Rev. 65(1): 36-48; Finn et al. (2018), Cell Rep. 22(9): 2227-2235, both incorporated by reference) hydrodynamic injection of plasmid DNA (Suda T and Liu D,)2007) Mol. Ther. 15(12): 2063-2069, herein incorporated by reference), or ribonucleoprotein complexes of sgRNA and associated with gold nanoparticles (Lee, K.; Conboy, M.; Park, H. M.; Jiang, F.; Kim, H. J.; Dewitt, M. A.; Mackley, V. A.; Chang, K.; Rao, A.; Skinner, C.; et al. Nanoparticle Delivery of Cas9 Ribonucleoprotein and Donor DNA in Vivo Induces Homology-Directed DNA Repair. Nat. Biomed. Eng. 2017, 1 (11), 889-90).

Example 7.5: Disease Correction in a Murine Model with a Humanized Locus

To evaluate the efficacy of an identical base editor construct as would be used for human therapy, a mouse model in which the nucleotides near W392 are altered to match the sequence in humans around W402 is needed. This can be accomplished by a variety of techniques, including use of an RGN and an HDR template to cut and replace the locus in mouse embryos.

Due to the high degree of amino acid conservation, most nucleotides in the mouse locus can be altered to those of the human sequence with silent mutations as shown in Table 17. The only base changes resulting in altered coding sequence in the resulting engineered mouse genome occur after the introduced stop codon.

TABLE 17

Nucleotide mutations to generate a humanized mouse locus

| Feature | Human (W402X) Nucleotide (SEQ ID NO: 225) | Human (W402X) Encoded AA | Mouse (W392X) Nucleotide (SEQ ID NO: 226) | Mouse (W392X) Encoded AA | Humanized Mouse Nucleotide (SEQ ID NO: 227) | Humanized Mouse Encoded AA |
|---|---|---|---|---|---|---|
| Proto-spacer | G | E | A | G | G | G |
| | G | E | G | E | G | E |
| | A | | A | | A | |
| | G | | A | | G | |
| | C | Q | C | Q | C | Q |
| | A | | A | | A | |
| | G | | A | | G | |
| | C | L | C | L | C | L |
| | T | | T | | T | |
| | C | | C | | C | |
| | T | STOP | T | STOP | T | STOP |
| | A | | A | | A | |
| | G | | G | | G | |
| | G | A | G | A | G | A |
| | C | | C | | C | |
| | C | | A | | C | |
| | G | E | G | E | G | E |
| | A | | A | | A | |
| | A | | G | | A | |
| | G | V | G | V | G | V |
| | T | | T | | T | |
| | G | | C | | G | |
| | T | S | T | S | T | S |
| | C | | C | | C | |
| | G | | A | | G | |
| PAM, non-critical | C | Q | A | K | C | Q |
| | A | | A | | A | |
| | G | | G | | G | |
| | G | A | G | A | G | A |
| PAM, critical | C | | C | | C | |
| | C | | T | | C | |

Upon engineering of this mouse strain, similar experiments will be performed as described in Example 7.4.

Example 8: Targeting Mutations Responsible for Friedreich Ataxia

The expansion of the trinucleotide repeat sequence causing Friedreich's Ataxia (FRDA) occurs in a defined genetic locus within the FXN gene, referred to as the FRDA instability region. RNA guided nucleases (RGNs) may be used for excising the instability region in FRDA patient cells. This approach requires 1) an RGN and guide RNA sequence that can be programmed to target the allele in the human genome; and 2) a delivery approach for the RGN and guide sequence. Many nucleases used for genome editing, such as the commonly used Cas9 nuclease from *S. pyogenes* (SpCas9), are too large to be packaged into adeno-associated viral (AAV) vectors, especially when considering the length of the SpCas9 gene and the guide RNA in addition to other genetic elements required for functional expression cassettes. This makes a viable approach using SpCas9 unlikely.

Compact RNA guided nucleases of the invention, for example APG03850, are uniquely well suited for the excision of the FRDA instability region. APG03850 has a PAM requirement that is in the vicinity of the FRDA instability region. Additionally, APG03850 can be packaged into an AAV vector along with a guide RNA. Packing two guide RNAs would likely require a second vector, but this approach still compares favorably to what would be required of a larger nuclease such as SpCas9, which would require splitting the protein sequence between two vectors.

Table 18 shows the location of genomic target sequences suitable for targeting APG03850 to the 5' and 3' flanks of the FRDA instability region, as well as the sequence of the sgRNAs for the genomic targets. Once at the locus, the RGN would excise the FA instability region. Excision of the region can be verified with Illumina sequencing of the locus.

TABLE 18

Genomic target sequences for RGN systems

| Guide No. | Location relative to FRDA instability region | Genome target sequence (SEQ ID NO.) | sgRNA (SEQ ID NO.) |
|---|---|---|---|
| 1 | 5' | 228 | 229 |
| 2 | 5' | 230 | 231 |
| 3 | 3' | 232 | 233 |
| 4 | 3' | 234 | 235 |

Example 9: Targeting Mutations Responsible for Sickle Cell Diseases

Targeting sequences within the BCL11A enhancer region (SEQ ID NO: 236) may provide a mechanism for increasing fetal hemoglobulin (HbF) to either cure or alleviate the symptoms of sickle cell diseases. For example, genome wide association studies have identified a set of genetic variations at BCL11A that are associated with increased HbF levels. These variations are a collection of SNPs found in non-coding regions of BCL11A that function as a stage-specific, lineage-restricted enhancer region. Further investigation revealed that this BCL11A enhancer is required in erythroid cells for BCL11A expression (Bauer et al, (2013) Science 343:253-257, incorporated by reference herein). The enhancer region was found within intron 2 of the BCL11A gene, and three areas of DNaseI hypersensitivity (often indicative of a chromatin state that is associated with regulatory potential) in intron 2 were identified. These three areas were identified as "+62", "+58" and "+55" in accordance with the distance in kilobases from the transcription start site of BCL11A. These enhancer regions are roughly 350 (+55); 550 (+58); and 350 (+62) nucleotides in length (Bauer et al., 2013).

Example 9.1: Identifying Preferred RGN Systems

Here we describe a potential treatment for beta-hemoglobinopathies using an RGN system that disrupts BCL11A binding to its binding site within the HBB locus, which is the gene responsible for making beta-globin in adult hemoglobin. This approach uses NHEJ which is more efficient in mammalian cells. In addition, this approach uses a nuclease of sufficiently small size that can be packaged into a single AAV vector for in vivo delivery.

The GATA1 enhancer motif in the human BCL11A enhancer region (SEQ ID NO: 236) is an ideal target for disruption using RNA guided nucleases (RGNs) to reduce BCL11A expression with concurrent re-expression of HbF in adult human erythrocytes (Wu et al. (2019) Nat Med 387:2554). Several PAM sequences compatible with APG03850 or APG09208 are readily apparent at the genetic locus surrounding this GATA1 site. These nucleases have a PAM sequence of 5'-nnnnG-3' (SEQ ID NO: 42) and 5'-nnnnC-3' (SEQ ID NO: 62), respectively, and are compact in size, potentially allowing their delivery along with an appropriate guide RNA in a single AAV or adenoviral vector. This delivery approach bestows multiple advantages relative to others, such as access to hematopoietic stem cells and a well-established safety profile and manufacturing techniques.

The commonly used Cas9 nuclease from S. pyogenes (SpyCas9) requires a PAM sequence of 5'-NGG-3', (SEQ ID NO: 256) several of which are present near the GATA1 motif. However, the size of SpyCas9 prevents packaging into a single AAV or adenoviral vector and thus forgoes the aforementioned advantages of this approach. While a dual delivery strategy may be employed, it would add significant manufacturing complexity and cost. Additionally, dual viral vector delivery significantly decreases the efficiency of gene correction, since a successful edit in a given cell requires infection with both vectors.

An expression cassette encoding a human codon optimized APG03850 or APG09208 is produced, similar to those described in Example 4. Expression cassettes which express guide RNAs for RGNs APG03850 or APG09208 are also produced. These guide RNAs comprise: 1) a protospacer sequence that is complementary to either the non-coding or coding DNA strand within the BCL11A enhancer locus (the target sequence) and 2) an RNA sequence required for association of the guide RNA with the RGN. Because several potential PAM sequences for targeting by APG03850 or APG09208 surround the BCL11A GATA1 enhancer motif, several potential guide RNA constructs are produced to determine the best protospacer sequence that produces robust cleavage and NHEJ mediated disruption of the BCL11A GATA1 enhancer sequence. The target genomic sequences in Table 19 are evaluated to direct the RGN to this locus using the sgRNA provided in Table 19.

TABLE 19

Target Sequences for BCL11A GATA1 enhancer locus using APG03850 or APG09208

| Guide | RGN | Target genomic sequence (SEQ ID NO.) | sgRNA (SEQ ID NO.) |
|---|---|---|---|
| 1 | APG03850 | 237 | 238 |
| 2 | APG03850 | 239 | 240 |
| 3 | APG03850 | 241 | 242 |
| 4 | APG09208 | 243 | 244 |
| 5 | APG09208 | 245 | 246 |
| 6 | APG09208 | 247 | 248 |

To evaluate the efficiency with which APG03850 or APG09208 generates insertions or deletions that disrupt the BCL11A enhancer region, human cell lines such as human embryonic kidney cells (HEK cells) are used. A DNA vector comprising an RGN expression cassette (for example, as described in Example 4) is produced. A separate vector comprising an expression cassette comprising a coding sequence for a guide RNA sequence of Table 16 is also produced. Such an expression cassette may further comprise a human RNA polymerase III U6 promoter (SEQ ID NO: 260), as described in Example 4. Alternatively, a single vector comprising expression cassettes of both the RGN and guide RNA may be used. The vector is introduced into HEK cells using standard techniques such as those described in Example 4, and the cells are cultured for 1-3 days. Following this culture period, genomic DNA is isolated and the frequency of insertions or deletions is determined by using T7 Endonuclease I digestion and/or direct DNA sequencing, as described in Example 4.

A region of DNA encompassing the target BCL11A region is amplified by PCR with primers containing Illumina Nextera XT overhang sequences. These PCR amplicons are either examined for NHEJ formation using T7 Endonuclease I digestion, or undergo library preparation following the Illumina 16S Metagenomic Sequencing Library protocol or a similar Next Generation Sequencing (NGS) library preparation. Following deep sequencing, the reads generated are analyzed by CRISPResso to calculate rates of editing. Output alignments are hand-curated to confirm insertion and deletion sites. This analysis identifies the preferred RGN and the corresponding preferred guide RNA (sgRNA). The analysis may result in both APG03850 and APG09208 being equally preferred. Additionally, the analysis may determine there is more than one preferred guide RNA, or that all target genomic sequences in Table 16 are equally preferred.

Example 9.2: Assay for Expression of Fetal Hemoglobin

In this example, APG03850 or APG09208 generated insertions or deletions disrupting the BCL11A enhancer region are assayed for expression of fetal hemoglobin. Healthy human donor CD34+ hematopoietic stem cells (HSCs) are used. These HSCs are cultured and vector(s) comprising expression cassettes comprising the coding regions of the preferred RGN and the preferred sgRNA are introduced using methods similar to those described in Example 8.1. Following electroporation, these cells are differentiated in vitro into erythrocytes using established protocols (for example, Giarratana et al. (2004) Nat Biotechnology 23:69-74, herein incorporated by reference). The expression of HbF is then measured using western blotting with an anti-human HbF antibody, or quantified via High Performance Liquid Chromatography (HPLC). It is expected that successful disruption of the BCL11A enhancer locus will lead to an increase in HbF production when compared to HSCs electroporated with only the RGN but no guide.

Example 9.3: Assay for Decreased Sickle Cell Formation

In this example, APG03850- or APG09208-generated insertions or deletions disrupting the BCL11A enhancer region are assayed for decreased sickle-cell formation. Donor CD34+ hematopoietic stem cells (HSCs) from patients afflicted with sickle cell disease are used. These HSCs are cultured and vector(s) comprising expression cassettes comprising the coding regions of preferred RGN and the preferred sgRNA are introduced using methods similar to those described in Example 8.1. Following electroporation, these cells are differentiated in vitro into erythrocytes using established protocols (Giarratana et al. (2004) Nat Biotechnology 23:69-74). The expression of HbF is then measured using western blotting with an anti-human HbF antibody, or quantified via High Performance Liquid Chromatography (HPLC). It is expected that successful disruption of the BCL11A enhancer locus will lead to an increase in HbF production when compared to HSCs electroporated with only the RGN but no guide.

Sickle cell formation is induced in these differentiated erythrocytes by the addition of metabisulfite. The numbers of sickled vs normal erythrocytes are counted using a microscope. It is expected that the numbers of sickled cells are less in cells treated with APG03850 or APG09208 plus sgRNAs than with cells untreated, or treated with RGNs alone.

Example 9.4: Disease Treatment Validation in a Murine Model

To evaluate the efficacy of using APG03850 or APG09208 for disruption of the BCL11A locus, suitable humanized mouse models of sickle cell anemia are used. Expression cassettes encoding for the preferred RGN and for the preferred sgRNA are packaged into AAV vectors or adenovirus vectors. In particular, adenovirus type Ad5/35 is effective at targeting HSCs. A suitable mouse model containing a humanized HBB locus with sickle cell alleles is chosen, such as B6; FVB-Tg(LCR-HBA2,LCR-HBB*E26K)53Hhb/J or B6.Cg-Hbatm1Paz Hbbtm1Tow Tg(HBA-HBBs)41Paz/HhbJ. These mice are treated with granulocyte colony-stimulating factor alone or in combination with plerixafor to mobilize HSCs into circulation. AAVs or adenoviruses carrying the RGN and guide plasmid are then injected intravenously, and the mice are allowed to recover for a week. Blood obtained from these mice is tested in an in vitro sickling assay using metabisulfite, and the mice are followed longitudinally to monitor mortality rates and hematopoietic function. It is expected that treatment with AAVs or adenoviruses carrying an RGN and guide RNA will reduce sickling, mortality, and improve hematopoietic function when compared to mice treated with viruses lacking both expression cassettes, or with viruses carrying the RGN expression cassette alone.

Example 10: Testing Different Delivery Formats

To determine if the RGNs are capable of delivery in different formats, mRNA and RNP nucleofection delivery was tested with primary T-cells. Purified CD3+ T-cells or peripheral blood mononuclear cells (PBMCs) were thawed, activated using CD3/CD28 beads (ThermoFisher) for 3 days, then nucleofected using the Lonza 4D-Nucleofector X unit and Nucleocuvette strips. The P3 Primary Cell kit was used for both mRNA and RNP delivery. Cells were transfected using the EO-115 and EH-115 programs for mRNA and RNP delivery respectively. Cells were cultured in CTS OpTimizer T cell expansion medium (ThermoFisher) containing IL-2, IL-7, and IL-15 (Miltenyi Biotec) for 4 days post nucleofection before being harvested using a Nucleospin Tissue genomic DNA isolation kit (Machery Nagel).

Amplicons surrounding the editing sites were generated by PCR using primers identified in Table 4 and subjected to NGS sequencing using the Illumina Nextera platform using 2×250 bp paired end sequencing following the method in Example 4.

TABLE 20 mRNA and RNP delivery of RGNs in primary T-cells

| RGN | Delivery Method | SGN | % Editing |
|---|---|---|---|
| APG01604 | mRNA, Nucleofection | SGN001671 | 1.18 |
| APG01604 | mRNA, Nucleofection | SGN001673 | 22.7 |
| APG01604 | RNP, Nucleofection | SGN001673 | 0.56 |
| APG01604 | mRNA, Nucleofection | SGN001674 | 0.63 |
| APG01604 | RNP, Nucleofection | SGN001674 | 0.77 |
| APG01868 | mRNA, Nucleofection | SGN001684 | 77.85 |
| APG01868 | RNP, Nucleofection | SGN001684 | 83.73 |
| APG01868 | mRNA, Nucleofection | SGN001691 | 82.53 |
| APG01868 | RNP, Nucleofection | SGN001691 | 80.7 |
| APG01868 | mRNA, Nucleofection | SGN001692 | 76.84 |
| APG01868 | RNP, Nucleofection | SGN001692 | 86.06 |
| APG01868 | mRNA, Nucleofection | SGN001785 | 0.22 |
| APG01868 | RNP, Nucleofection | SGN001785 | 0.43 |

Both mRNA and RNP delivery showed successful editing with APG01868. APG01868 showed successful editing with RNPs at several genomic targets. RNP delivery was limited with APG01604, but showed equal editing rates with mRNA delivery.

Example 11: Base Editor Testing

To determine if APG09298 and APG01604 could perform cytosine base editing in mammalian cells, a cytosine deaminase was operably fused to the nickase version of each RGN to produce a fusion protein. Residues predicted to deactivate the RuvC domain of the RGNs APG09298 and APG01604 were identified and the RGNs were modified to nickase variants. A nickase variant of an RGN is referred to herein as "nRGN". It should be understood that any nickase variant of an RGN may be used to produce a fusion protein of the invention.

Deaminase and nRGN nucleotide sequences codon optimized for mammalian expression were synthesized as fusion proteins with an N-terminal nuclear localization tag and cloned into the pTwist CMV (Twist Biosciences) expression plasmid. Each fusion protein comprises, starting at the amino terminus, the SV40 NLS (SEQ ID NO: 251) operably linked at the C-terminal end to 3×FLAG Tag (SEQ ID NO: 252), operably linked at the C-terminal end to a deaminase (APG05840), operably linked at the C-terminal end to a peptide linker, operably linked at the C-terminal end to the nRGN (nAPG09298 or nAPG01604), operably linked at the C-terminal end to a peptide linker, operably linked at the C-terminal end to a uracil stabilizing protein (USP2 set forth as SEQ ID NO: 1089), finally operably linked at the C-terminal end to the nucleoplasmin NLS (SEQ ID NO: 253). The amino acid sequence of the APG05840-nAPG09298-USP2 and APG05840-nAPG01604-USP2 fusion proteins are set forth as SEQ ID NOs: 1090 and 1091, respectively.

Expression plasmids comprising an expression cassette encoding a sgRNA were also produced. Human genomic target sequences and the sgRNA sequences for guiding the fusion proteins to the genomic targets are indicated in Table 3 and the primers for amplification of the genomic region are listed in Table 4. The same methods in Example 4 for plasmid delivery to mammalian cells and amplicon sequencing were used to test the base editing capabilities of these RGNs when tethered to a cytosine deaminase.

TABLE 21

Estimated Base Editing Rates for each RGN tested

| Construct | Target | % Mutated Reads |
|---|---|---|
| APG05840-nAPG09298-USP2 | SGN001159 | 6.96 |
| APG05840-nAPG09298-USP2 | SGN001159 | 9.91 |
| APG05840-nAPG09298-USP2 | SGN001162 | 21.59 |

TABLE 21-continued

Estimated Base Editing Rates for each RGN tested

| Construct | Target | % Mutated Reads |
|---|---|---|
| APG05840-nAPG09298-USP2 | SGN001162 | 27.05 |
| APG05840-nAPG09298-USP2 | SGN001163 | 17.85 |
| APG05840-nAPG09298-USP2 | SGN001163 | 20.74 |
| APG05840-nAPG09298-USP2 | SGN001164 | 4.74 |
| APG05840-nAPG09298-USP2 | SGN001164 | 7.89 |
| APG05840-nAPG09298-USP2 | SGN001165 | 31.99 |
| APG05840-nAPG09298-USP2 | SGN001165 | 62.47 |
| APG05840-nAPG09298-USP2 | SGN001166 | 23.49 |
| APG05840-nAPG09298-USP2 | SGN001166 | 29.56 |
| APG05840-nAPG01604-USP2 | SGN001245 | 9.67 |
| APG05840-nAPG01604-USP2 | SGN001246 | 1.4 |
| APG05840-nAPG01604-USP2 | SGN001249 | 1.72 |
| APG05840-nAPG01604-USP2 | SGN001250 | 13.41 |
| APG05840-nAPG01604-USP2 | SGN001251 | 0.87 |
| APG05840-nAPG01604-USP2 | SGN001252 | 4.28 |

Example 12: Off Target Analysis

To assess the specificity of the nucleases, off target editing was determined at potential sites identified via bioinformatics. Potential off target sites for APG01604 were identified by targets with less than five mismatches in the target sequence and at least one residue match in the PAM sequence.

The same methods as those described in Example 4 for plasmid delivery to mammalian cells and amplicon sequencing were used to test the specificity and off target editing of APG01604. From the same experiment where the SGNs in Table 22 were tested for on target editing, the potential off target locations in Table 23 were assayed for potential editing. The primers in Table 24 were used to amplify potential off target sites with sequence similarity to the on target site to look for off target editing.

TABLE 22

SGNs used to look for off target editing

| SGN | Gene | On Target Forward Primer (SEQ ID NO) | On Target Reverse Primer (SEQ ID NO) |
|---|---|---|---|
| SGN001675 | TRA | CCCTTGTCCATCACTGGCAT (1096) | ACCAAAGCTGCCCTTACCTG (1097) |
| SGN001594 | B2M | CCTTAATGTGCCTCCAGCCT (1092) | AGGAGAGACTCACGCTGGAT (1093) |
| SGN001674 | TRA | CCCTTGTCCATCACTGGCAT (1094) | ACCAAAGCTGCCCTTACCTG (1095) |

TABLE 23

Off target sequences assayed

| SGN | Off Target Number | Off target locus sequence | SEQ ID NO |
|---|---|---|---|
| SGN001594 | 1594-2 | AGCACAGCTAAGGCCTAAAGTTGAA | 1098 |
| SGN001594 | 1594-3 | AGCACAGCTAAGGCACCGGATTGGA | 1099 |
| SGN001594 | 1594-4 | AGCACAGCCAAGGCCAAGGGCTGAC | 1100 |
| SGN001594 | 1594-5 | AGCAGAGCTAAGGCCAAGGCAGGTG | 1101 |
| SGN001594 | 1594-6 | GGCACAGCTAAGGCCAGCAGTGGCC | 1102 |
| SGN001674 | 1674-2 | GTCTCTGAGCTGGTACATGGCAGAG | 1103 |
| SGN001674 | 1674-3 | GTCTTTTAGCTGGTACACGTGTGTC | 1104 |
| SGN001675 | 1675-2 | AGAAGATTTGTCACTGGATTCTGAG | 1105 |
| SGN001675 | 1675-3 | AGGACACTTGTCACTGGATTTAGGA | 1106 |
| SGN001675 | 1675-4 | AGGACACTTGTCACTGGATTTAGGA | 1107 |
| SGN001675 | 1675-5 | TGAGGACTTGTCACTGGATTCAGGG | 1108 |
| SGN001675 | 1675-6 | AGGAGACTTTTCACTGGATTTAGGG | 1109 |
| SGN001675 | 1675-7 | TGGACACTTGTCACTGGATTTAGGG | 1110 |
| SGN001675 | 1675-8 | CACAGACTTGTCACTGGATGTGGGG | 1111 |
| SGN001675 | 1675-9 | TACAGACATGTCACTGGATCTGGAA | 1112 |
| SGN001675 | 1675-10 | AACACACTTGTCATTGGATTTAGGG | 1113 |
| SGN001675 | 1675-11 | TACAGACTGGTCACTGGATGCTGGT | 1114 |
| SGN001675 | 1675-12 | AGGACACTTGTCACTGGATTTAGCA | 1115 |
| SGN001675 | 1675-13 | CTAAGACTTGTTACTGGATTGTGTG | 1116 |
| SGN001675 | 1675-14 | CTCAGACTGGTCACTGGATAATGTA | 1117 |

TABLE 24

Primers used to amplify off target regions

| Description | Primer sequence | SEQ ID NO |
|---|---|---|
| 1594-2 FWD | CCAGAAGCCAGCAGATGACA | 1118 |
| 1594-2 REV | GAGTGGTGGGCTCTCAATCC | 1119 |
| 1594-3 FWD | AGCAACACCATCCAAAGGTT | 1120 |
| 1594-3 REV | GGGAGTGATGATAATGCGGG | 1121 |
| 1594-4 FWD | TGGACTAGAGAGGGTTGGGG | 1122 |
| 1594-4 REV | TCTCTTTCCACGAGCAGCAG | 1123 |
| 1594-5 FWD | GCCTTTGACCTTCCCAGATT | 1124 |
| 1594-5 REV | ACCATTGGAAAGGTGGATGC | 1125 |
| 1594-6 FWD | GGCTTCAGGCTTTCCTCTGT | 1126 |
| 1594-6 REV | AGCATGCTGGCCTAAAGTGA | 1127 |
| 1674-2 FWD | ACCATTGGTCTGCTCAGGTG | 1128 |
| 1674-2 REV | CCAAAACCTGCAGTGGCTTC | 1129 |
| 1674-3 FWD | GGAGAGGAACTGGGCATGAG | 1130 |
| 1674-3 REV | TCCGTCTCTCCTAGGTCTGC | 1131 |
| 1675-2 FWD | CCATGACTGGCCCTTCTGTT | 1132 |
| 1675-2 REV | GGGTAGAGTACATGGCGACG | 1133 |
| 1675-3 FWD | CCCTCCCACCAGAAGCTCTA | 1134 |
| 1675-3 REV | GATAAGAGGCCCAAGGACCG | 1135 |
| 1675-4 FWD | CACTTGACACGTGAGCCTCT | 1136 |
| 1675-4 REV | CCTCTTTCAGCCTCTGGTGG | 1137 |
| 1675-5 FWD | GACAGACTTGGTTCTGCCCT | 1138 |
| 1675-5 REV | CCTCCCCTCCTTCCTAGCTT | 1139 |
| 1675-6 FWD | TGCTGTAGTGGGTCGAACAG | 1140 |
| 1675-6 REV | TTTCACCATGCTGGCTAGGC | 1141 |
| 1675-7 FWD | CCCAGCCACATGGAACTAAG | 1142 |
| 1675-7 REV | GGACCCTAGGAGTTCCTTGT | 1143 |
| 1675-8 FWD | GCAGGTTGATAGGGAAGAGC | 1144 |
| 1675-8 REV | TCATCTCCCAGCTGATGACA | 1145 |
| 1675-9 FWD | CCACCTGTTGCACAAATCCG | 1146 |
| 1675-9 REV | TCCTCCCCTGGGAACATGAT | 1147 |
| 1675-10 FWD | GAGGTACTGGGAGTGGGGAT | 1148 |
| 1675-10 REV | CTTCCTGCCTCTTCCAGCTC | 1149 |
| 1675-11 FWD | GCACAGCTTTTGTCATGGGG | 1150 |
| 1675-11 REV | GGGGATGAGAAAACAGAGCCA | 1151 |
| 1675-12 FWD | CCATGCCCCATTCTGAAGGT | 1152 |
| 1675-12 REV | TTCCCCTCCTCTAGACTGCC | 1153 |
| 1675-13 FWD | CTTGAGCCCAGGAGTTTGAG | 1154 |
| 1675-13 REV | TGCATTCTTGGGATGACCTC | 1155 |
| 1675-14 FWD | ACTGCTTTTCCCTGGACACA | 1156 |
| 1675-14 REV | GGTCACAAGTCCCACTGGTC | 1157 |

Using plasmid delivery, there was no detectable off target editing at two of the three guides tested. One off target site for SGN001675, 1675-8, showed 2% editing at the off target locus. There was duplication of 132 bp of the genomic region at the cut site in the NGS reads. Two off target sites, 1675-7 and 1675-13, were unable to be sequenced due to poor primer amplification.

TABLE 25

Off Target Editing for SGN001594 and APG08167

| Off target Number | Total Mismatches in Target | Total Mismatches in Seed | Total Matches in PAM | % Editing |
|---|---|---|---|---|
| SGN001594 | 0 | 0 | 3 | 42.79 |
| 1594-2 | 2 | 2 | 3 | 0 |
| 1594-3 | 2 | 2 | 3 | 0.01 |

TABLE 25-continued

Off Target Editing for SGN001594 and APG08167

| Off target Number | Total Mismatches in Target | Total Mismatches in Seed | Total Matches in PAM | % Editing |
|---|---|---|---|---|
| 1594-4 | 2 | 1 | 2 | 0 |
| 1594-5 | 3 | 2 | 2 | 0 |
| 1594-6 | 2 | 1 | 1 | 0 |

TABLE 26

Off Target Editing for SGN001675 and APG08167

| Offtarget Number | Total Mismatches in Target | Total Mismatches in Seed | Total Matches in PAM | % Editing |
|---|---|---|---|---|
| SGN001675 | 0 | 0 | 3 | 33.115 |
| 1675-8 | 2 | 1 | 3 | 2.02 |
| 1675-5 | 4 | 0 | 3 | 0.06 |
| 1675-10 | 3 | 1 | 3 | 0.03 |
| 1675-12 | 4 | 0 | 2 | 0.02 |
| 1675-6 | 4 | 0 | 3 | 0 |
| 1675-2 | 4 | 0 | 3 | 0 |
| 1675-3 | 4 | 0 | 3 | 0 |
| 1675-4 | 4 | 0 | 3 | 0 |
| 1675-9 | 3 | 1 | 3 | 0 |
| 1675-11 | 2 | 0 | 2 | 0 |
| 1675-14 | 4 | 1 | 2 | 0 |
| 1675-13 | 4 | 0 | 2 | Issue sequencing |
| 1675-7 | 4 | 0 | 3 | Issue sequencing |

TABLE 27

Off Target Editing for SGN001674 and APG08167

| Offtarget Number | Total Mismatches in Target | Total Mismatches in Seed | Total Matches in PAM | % Editing |
|---|---|---|---|---|
| SGN001674 | 0 | 0 | 3 | 52.17 |
| 1674-2 | 2 | 1 | 3 | 0 |
| 1674-3 | 2 | 0 | 1 | 0.03 |

Example 13: Guide RNA Backbone Variant Testing

APG08167 and APG01604 are approximately 62.72% identical, but recognize the same PAM, share the same crRNA, and have a closely related tracrRNA sequence. Because of the similarity of the guide RNA sequences, all data previously generated for APG01604 used the APG08167 tracrRNA backbone. These studies were performed to confirm that the APG01604 protein is more active with a tracrRNA encoded in the APG08167 genome (the native APG08167 tracrRNA). Different spacer lengths in the crRNA were also tested to determine if the APG01604 protein prefers a 20 or 25 base pair spacer sequence.

To do this, synthetic crRNAs with six different target sequences that contained a 20 or 25 base pair target were generated. The different crRNAs were combinatorially combined with a synthetic tracrRNA from the APG08167 or APG01604 genome. RNPs were formed and the RNP complexes were nucleofected into HEK293T cells. The standard methods in Example 4 were used for determining the editing rate in cells.

TABLE 28 crRNA Sequences

| Gene | Spacer | Spacer Length | SEQ ID NO |
|---|---|---|---|
| B2M | A | 20 | 1158 |
|  | B | 20 | 1159 |
|  | C | 20 | 1160 |
|  | D | 20 | 1161 |
|  | A | 25 | 1162 |
|  | B | 25 | 1163 |
|  | C | 25 | 1164 |
|  | D | 25 | 1165 |
| TRA | E | 20 | 1166 |
|  | F | 20 | 1167 |
|  | E | 25 | 1168 |
|  | F | 25 | 1169 |

TABLE 29 tracrRNA Sequences

| tracrRNA | SEQ ID NO |
|---|---|
| APG08167 tracrRNA | 1170 |
| APG01604 tracrRNA | 1171 |

TABLE 30

Sequencing Primer Sequences

| Primer | SEQ ID NO |
|---|---|
| TRAC Left Primer | 1170 |
| TRAC Right Primer | 1171 |
| B2M Left Primer | 1172 |
| B2M Right Primer | 1173 |

TABLE 31

Editing results for APG01604 backbone and target length testing

| Gene | Spacer | Spacer Length | Backbone | Editing efficiency (%) |
|---|---|---|---|---|
| B2M | A | 20 | APG01604 tr | 0.21 |
|  | B | 20 | APG01604 tr | 0.08 |
|  | C | 20 | APG01604 tr | 0.27 |
|  | D | 20 | APG01604 tr | 0.17 |
|  | A | 25 | APG01604 tr | 0.15 |
|  | B | 25 | APG01604 tr | 0 |
|  | C | 25 | APG01604 tr | 1.33 |
|  | D | 25 | APG01604 tr | 0.31 |
|  | A | 20 | APG08167 tr | 6.58 |
|  | B | 20 | APG08167 tr | 1.75 |
|  | C | 20 | APG08167 tr | 6.99 |
|  | D | 20 | APG08167 tr | 64.6 |
|  | A | 25 | APG08167 tr | 22.7 |
|  | B | 25 | APG08167 tr | 2.36 |
|  | C | 25 | APG08167 tr | 52.51 |
|  | D | 25 | APG08167 tr | 82.58 |
| TRA | E | 20 | APG01604 tr | 0.05 |
|  | F | 20 | APG01604 tr | 0.01 |
|  | E | 25 | APG01604 tr | 0.02 |
|  | F | 25 | APG01604 tr | 0.01 |

SEQUENCE LISTING (1185 sequences)

SEQ ID NO: 1 - protein, 1735 aa, Pedobacter sp.
MTKNILGLDLGTNSIGWALIKIDHENKTLKIIALGSRIIPMDGQEFSKFNAGQKIESAAGNRTALHRARITKERYLLRRDRLHLVLNLLEALPNHYKIEVDFERNDKRCGQFKEGKEPKMAYLPTKNLENKFDFYFEEAFNEMIEDLQKVNPEIKNEKKKRVPKDWTIYFLRNKAMSQKVSLEELAWVLLSYNQKRGTDSEEIENEDEKSEIKEQIDLKVIKAEKKVDVNGAFFEITLNDAENFKYKEYTTKQLTFEDDVKEVTKILKLDEAGNIINEKTAYQISDLYNLTLANIEHTDINDKKAKHKYDFIYTNGWCTEKKKENFDVTYQKLEKQIKEESKVITELFVVSNKYDFAGKPESIIPSIKLPDFNSEGSKDWTLLKKKTEKEIVKSEKTLSGWIYDVLKNDVNTGERTKIIGGLFQTIDRKFYREELYQIINTQRKFHTSTLDDKDTFEKCVKLLYPHNKDHSKTLLENKQALTNLLIEDILLYQRPLKSKKSEISDCKYEIDYWKEDVNISTGEVVEIPVYKKAIFASHPLFQEFRIWDKIHNIKLIQLESKDADGNTQTNVDITSQYFKPENYRALFNHFNGRSTVAIDDFLKFCEEQFKLGIGKKGERKILWNYPVEEEFKGNETRKGFENRFRKCGFDGFDDFMTQQKEIELWHYLYSVSSAERKKVSQVKDSSDPKFGKTGIWNFFTKYFKDENISLETLEKLCRDFETYPKFTSKYASYSVKALNKMLAVMRVGKNFLTAESVNEKWQEKYIERADTIIKKNNEIDWSAESIDLTDIILNDVNVKNGEIPFPKGLFNTFKSFETVDDFEFLNLTQASYFIYGRHSELAQAKYWNSPTKIREEITKELKHHSLNNPTAEKVLKETLKVVADIWEIYGNSEEKFFNEIHLEVARELQKSNQEKKDIIERQKNNRAENNRIRNILEEFLSSSPYNAKRGNQDHFERLKIVEDGAKVRSYSDKEFYSNNKDKFSKIDIEVILKKKKITQSDFEKYKLWIEQGYKSPYTDQIIKLTDLFDGNKYNVDHIFSRAAITNDSLNNKVVCEAVINRFKSYKTGREFIAQFGGKTHTIFDDKLNKNVTFSLIDEDAYVSLVKSQFKDAKRLILLSKEVPKAFTESQLNNAKYIARKAMELLSHIVREEGEVEFRSKNVLPVSGAITDRLKKEWKINQIWTELLKPRFERLNKIHNSEAFGSYAISKSGHQYFDINTKYILGENDKFDLKRLDHRHHALDALIIALCTDNHVQYFNNINSGITNKKKGKMEAIKKQRAGIKRQIMYSEKDKENPNEKVWRYMLPGSFRNKESVNNEKDSVVDLSWENNYSAKESNDYRKTILECLDNCIVSFKNDFKIVSKSSNKYESYYDENGNLRLDSNGKPQKEFISQQNNNQKHWSVRKPLHTDNPSAEITLQFDRLKLIDNLGKVDLIIEEKIKDAVKEILGMHNNKIGKAESYLKKNPLILEEKKIEYTDFKISNKKYRKRQPITNLSVRTGTGALPTYDSVVDRINKVSDFVLRNELLQHLKINDNDIDKAFSIEGINEFNSNRKIPVFRLPISESATLKFKIGHKNSNSHKWVETGGNFHFRIADEENSRDYETIPLRIAIEMEKDNIIRRQIVDNENEIVLSPNDLVYVPLEKNEIVDFNNLTIQQIKRIYKFVFSTKKEAHFIPYSSSAEIIKNENGTNGYSERTKDFFDGNVLQDDKGKPIQVKSVCWKLKVDRLGNISKA

SEQ ID NO: 2 - RNA, 17 nt, Pedobacter sp.
  source 1..17: mol_type = other RNA
gttgtgatttgctttca

SEQ ID NO: 3 - RNA, 84 nt, Pedobacter sp.
  source 1..84: mol_type = other RNA
tgaaagcaaatcacaataaggattattccgttgtgaaaacatttgggttgcctcttgtccacaaatcaggaggcttttttattt

SEQ ID NO: 4 - RNA, 134 nt, synthetic construct
  variation 1..29: note = Can be any sequence
  source 1..134: mol_type = other RNA
nnnnnnnnnnnnnnnnnnnnnnnnnnnnngttgtgatttgctttcaaaagtgaaagcaaatcacaataaggattattccgttgtgaaaacatttgggttgcctcttgtccacaaatcaggaggcttttttattt

SEQ ID NO: 5 - RNA, 135 nt, synthetic construct
  misc_feature 1..135: note = source = /note="Description of Artificial Sequence: Syntheticpolynucleotide"
  source 1..135: mol_type = other RNA
gagcggacagcagcttcctatatctcgtacgttgtgatttgctttcaaaagtgaaagcaaatcacaataaggattattccgttgtgaaaacatttgggttgcctcttgtccacaaatcaggaggcttttttattt

SEQ ID NO: 6 - RNA, 135 nt, synthetic construct
  misc_feature 1..135: note = source = /note="Description of Artificial Sequence: Syntheticpolynucleotide"
  source 1..135: mol_type = other RNA
ccatgatatagacgttgtggctgttgtagtgttgtgatttgctttcaaaagtgaaagcaaatcacaataaggattattccgttgtgaaaacatttgggttgcctcttgtccacaaatcaggaggcttttttattt

SEQ ID NO: 7 - skipped

SEQ ID NO: 8 - protein, 1224 aa, Chitinophaga sp.
MKKLIVGLDLGVNSIGWAVVGDDDSNRQILGMGSRIIPLSPDDNNEFVTGNAISKNAKRTEKRTQRKGYDRYQQRRRKLVAFLERHSMMVEKELMCLPPLELWALRNKGITQALSSRELGRVLYHLNQRRGYRSSRSEESSDGKKNTAYVEEVKGRYEELKTRGITIGQHFYQKLQTAHNRNEPYRIKQQVFPRQAYIDEFDAIINQQKNHHSSLTADEIAFLRDEIIYMQRPLKSQKGLVSICEFEGQYRKNAKDAEVFVGPKVAPRSSPLAQVCKIWESINNITFTNKRREPYPINTDQKLRLFDALNKTERLSQKAIFFILGIKPGDGYTGNKQTAKGIQGNLTNAAISTIIPERKDLLNFELKIVVDEEDAHLINRSNGEIISTVQKKTVSADYERSPFFRLWHVIYSISDIDKCIETLMEKFGLTKEQAVALSRLDFRKAGFANKSARAMRKILPYLMDGHIFSDAMSLAGYNHSASLTHEENLKRQLKGSLPLLKKNSLRQPVVEKILNQMIGVMNAIIKEWGRPDEIRVELARELKQSAEERNKAFAALSKREREGEIITKRIEAEFRQFGIRATRNNILKWRLFHEISNDEARLNATCVYCGHPFGITDALRGSSVDIEHIIPKSKLFDDSQGNKTLVHRRCNEDKGDRTAFDFMSAKGESVLASYIETVDRLYQSNVISRHKRDRLLTTGDDIPKDFIERQLRETQYIARKAKEILEQICYNVWSTSGQITEYLRRIWGWNDVLMNLQLPVYRDLGLTEWKEYTDRDGNLHRQEVIKDWSKRNDHRHHAIDALTIACTRQGFIQRINRLNATNNREEMRASLNGNYDPKKNLLENYIFALKPFSTKQVEVAAAQILISFKPGKRVATLSKLKAKGKNSGTGVIVPRGPLSEESVYGRVRLMDSKKQPVRYLFEHPELIFKPYIRVLVEERLASYSQDLKKALASLKKDPIYLDGTKTIILEWGSCYKDEVVIKYPLTDIKAKDTQFIIDGHIRAIVNERLSQYKGNEKKAFEHPLYSDAACTKEIRSVRCLTGLTAVVSVKKDESGREIGFVKPGNNHHIALYTDAEGQKREHLCTFWHAVERKKWGMPAVITQPGVIWDNILQKQDNFPQAFLEKLPLEAWTFDKSLQQNEMFIVGLTIEEVQTCIDSFDYARLSKHLYRIQKLSSTGYKIVLRHHLATTIEHTRDMIGIASPSSFTGIKVYVSKTGKISMPHD

SEQ ID NO: 9 - RNA, 14 nt, Chitinophaga sp.
  source 1..14: mol_type = other RNA
gttgtgatttgctt

SEQ ID NO: 10 - RNA, 78 nt, Chitinophaga sp.
  source 1..78: mol_type = other RNA
aagcaaatcacaataaggatttttcttccgttgagaaatcattcacgccgccctcgtcgtttatcgggggcttttttt

SEQ ID NO: 11 - RNA, 125 nt, synthetic construct
  variation 1..29: note = Can be any sequence
  source 1..125: mol_type = other RNA
nnnnnnnnnnnnnnnnnnnnnnnnnnnnngttgtgatttgcttaaagaagcaaatcacaataaggatttttcttccgttgagaaatcattcacgccgccctcgtcgtttatcgggggcttttttt

SEQ ID NO: 12 - RNA, 126 nt, synthetic construct
  misc_feature 1..126: note = source = /note="Description of Artificial Sequence: Syntheticpolynucleotide"
  source 1..126: mol_type = other RNA
gagcggacagcagcttcctatatctcgtacgttgtgatttgcttaaagaagcaaatcacaataaggatttttcttccgttgagaaatcattcacgccgccctcgtcgtttatcgggggcttttttt

SEQ ID NO: 13 - RNA, 126 nt, synthetic construct
  misc_feature 1..126: note = source = /note="Description of Artificial Sequence: Syntheticpolynucleotide"
  source 1..126: mol_type = other RNA
ccatgatatagacgttgtggctgttgtagtgttgtgatttgcttaaagaagcaaatcacaataaggatttttcttccgttgagaaatcattcacgccgccctcgtcgtttatcgggggcttttttt

SEQ ID NO: 14 - skipped

SEQ ID NO: 15 - protein, 1457 aa, Mucilaginibacter sp.
MKNILGLDLGTNSIGWALIQSDFDNKEGKILGTGSRIIPMSQDIKDEYGKGNSISQTADRTRFRSLRRLRERHLLRRERLHRILNILGFLPEHYADQIDFKNRLGQYLPEKEPKLAYRNNEFIFKASFEEMLIDFREQQPEMLQGDKKVPYDWTIYYLRKKALTQKVEKAELAWLILNFNQKRGYYQLRGEEQQENPNKKVEFHSLKVVDVIADETQRGKAETWYSLILENGWVYRRSSKTPLDNWRDKQRDFIVTTDLNDDGSIKKDKDGNIKRSFRAPDENDWTLLKKKTEQDIDHANKTAGAYIYDHLLVAPDQKIKGKLVRTIERRFYKTELKAILAKQQNFHAELQNKDLFLDCVRELYRHNLSHLSNLNQKDTIHLLTEDIIFYQRPLRSQKSSIGNCPLEFRRYQNKEGGDQTEYLKVIPKSHPLYQEFRLWQWIYNLGIYQKEDDTNVTADLIKGIQGYQDLFDFLNSKKEIKQDTLIKFLLSQTGLKGKELNKAALTLRWNFVEDKTYPCNETGTEIRARLAKVAYIPENFLTAEKALSLWHIIYSVNDKKEYELALRKFAKKHQIDEETFFINFQKFPPFQSEYGAFSEKAIKKLLPLIRLGKYWHWEAIDPKSQERIEKILSGEADQNIKERIREKAMHLTREEHFQGLQLWLANYIVYDRHAEAANPDKWSTVSDLEDYLKELKQHSLRNPIVEQVVTETLRVVKDIWLTYGNGAKNFFDEIHIELAREMKNTMEERKRLTSIVTDNENTNLRIKALLVELFEDGNIENVRPYSPIQHEALKIFEDGILNSGIEIDDDILKISKTPQPTSTELKRYKLWLEQKYRSPYTGNVIPLNRLFTTDYEIEHIIPQSRFFDDSFSNKIICESAINKLKDKQLGLEFIKNHAGTIVELGLGKTARVFDEERYQDFVKANYTKNPGKRSKLMLEEIPDKMIARQLNDTRYISKFITSVLSNIVRSETKDDGVNSKNVLLCNGRITSVLRQDWGMNDIWNELILPRFERLNQITDSTVFTAWNENHQKFLPTVPMGFSKGFQRKRIDHRHHAMDALIIASCTRDHINLLNNEYAKSSKRFDLNRKLRKFEKVAYKSPVNGQQIDKDIPTVFIKPWQRFTIDAKCSLEDIIVSFKQNLRVINKTTNYFDGYKDEHGIVNFDNKGAPVKQQRKQTKGDSWAIRKPMHKDFVYGKVDLKHIKIPKGKFATAIRKSLDTTFDQKKIQTITDTGVQKILINYLQSKDNKAELAFSPEGIEDMNQNIRAYNDGKLHQPIKKVRVFEIGSRFPLGETGNKKTKYVETAKGTNLFFAIYQHKNKRNYETVPLNTVIERQKQHLSPVPTEDDKGGTLLFYLSPNDLVYVPTPDELGNNLGGLDIRNLNKEQRRRIYKVEKASGVECYFIRQDIAYLIKSYDATTKIGELESQNKLQTTMSSDRLKIADVCIKLKIDRLGISR

SEQ ID NO: 16 - RNA, 18 nt, Mucilaginibacter sp.
  source 1..18: mol_type = other RNA
gttgtgatttgctttcat

SEQ ID NO: 17 - RNA, 75 nt, Mucilaginibacter sp.
  source 1..75: mol_type = other RNA
atgaaagcaaatcacaataaggattattccgttgtgaaaacatctaagtcgcctcgccttacaatgcggggcttt

SEQ ID NO: 18 - RNA, 126 nt, synthetic construct
  source 1..126: mol_type = other RNA
  variation 1..29: note = Can be any sequence
nnnnnnnnnnnnnnnnnnnnnnnnnnnnngttgtgatttgctttcataaagatgaaagcaaatcacaataaggattattccgttgtgaaaacatctaagtcgcctcgccttacaatgcggggcttt

SEQ ID NO: 19 - RNA, 127 nt, synthetic construct
  misc_feature 1..127: note = source = /note="Description of Artificial Sequence: Syntheticpolynucleotide"
  source 1..127: mol_type = other RNA
gagcggacagcagcttcctatatctcgtacgttgtgatttgctttcataaagatgaaagcaaatcacaataaggattattccgttgtgaaaacatctaagtcgcctcgccttacaatgcggggcttt

SEQ ID NO: 20 - RNA, 127 nt, synthetic construct
  misc_feature 1..127: note = source = /note="Description of Artificial Sequence: Syntheticpolynucleotide"
  source 1..127: mol_type = other RNA
ccatgatatagacgttgtggctgttgtagtgttgtgatttgctttcataaagatgaaagcaaatcacaataaggattattccgttgtgaaaacatctaagtcgcctcgccttacaatgcggggcttt

SEQ ID NO: 21 - skipped

SEQ ID NO: 22 - protein, 1662 aa, Acidovorax sp.
MKKILGLDIGTTSIGYSIIKVSDEKNENIISDKVAASDINNDRIGIFEEAIGVRIINQDTDRFDRGLKLNDPKGSTLTPTANRRKFRGVRRMRNRYKLRRNKLYKVLSILGLTPDESYFTNKKGKRGKDNDIGKALYGLRERAAREKISLSELARVLLHLNQLRGYSSDRFANDEETKFDYYLTEVVEADWENRTAVFEKGSTEDVKYYQFKAKLRFVEPYVIVEDDEKTILYEVEGYIFKKELDFEVGDFITIKAPEFKQNKKGKVVIEEYYKITPTKPDATDWKYKYQTLHKNLSDWCKAGGTVGSYFYKNFYELTTLSRIRNNVVNREWYENEFDAIWTLQYEFYKDFFEKIDVSELVKGVFKDYSAVLNDVISKSGNKAQLQTLIKDKIIFYQRPWQQAKSKGRCEFEKIKVKRKFAIKGTGTKELREEHIGRKVVPRSHPIFQDFKVWQQINNVRLIWNTADEKINLFENAELSEKLTGKTIEKVKELLFKKLQGSKTLSWRTFVKEELGLDTYDEIEEKRKSKVSKKQGLDIETGEIVDSFFSVNFRKRKRDGTFDDIKLKGNTTKAELQNILKEKRAEWFDTLHNQNKKVTNLQLLWEIIYDITNSDATKVSSIIKKHFDFDESVCLTLAKVQFDDAGMANLSAKAIRNLLPLMSDGANYSKITKAKVDELISLNTSETDVDADDKLNGLKDFVTDRKARIRLSKFSNENDFKYLNYWEAAAIVYGSHSSKKSSETKIMERVKNHSMNNPVVEKIVNEAISIVNLLKEKYGFDEIRIELSRELRASADERQQMWEGMSNGAAKNEWAKKMLREIKQAMLDNNRDISYLDTEISNSNLDKIKIIEDVVKYQKPVEFKTKEKEYKLTEPTKAEVTKYLLWLEQNFKCPYTNQPIPLTDVFARGKVVEIEHIIPRERYYSNAYANKVITWREVNQEKGNKTAYEFIVSKRNPAGTVQVGKKEISLVSASQWENHVKEMFPKSGKRTNLLRKEIPEDPIERTLKENQYINKKLKEKLGELVGSDKVWVTSGAITDMLREKWKLNDIWKELVQERFLKFNNGEVKDRLNLKYTTKYYNNKTNQYEDVEKFAGMSKRIDHRHHALDAIIIACTKQSHIQYINNLNAINSADIENDDNKKTKYKGIKTDVCIGNSSSKFKFPWDENKFIPEVKQALQNILISHKNSNVLISPSKHRNNKDINSGKVASVRGELHLQTNYAKKKYFENEKIDIVKLIPLLFKKKFENQNQTLVRFKSFDEIIKEAVLKEKYQNVLISLFKDYDSEKLSTQTTKDFSKKILKRIEDEKLFIHEKSGEKMTWLSTFTEKNASVRPMGLAMDLNSEKEIKDISNPRLRRIGQYRLNYINKKIIEIKALKLPFKEEENNRIREVREIPLYNNAIYELRIKQKDGKYHWVEIKDVQHSDLENIEYAKQETTIAVKNKIKDFSLDELKERYISNPIFLSEKPTPVKKARQKSFFQDLYQLNDGRYVYSRDVFMTYVFVPEDSNRKDAKRELEFLKFFDAVKIVTLEKPEKIDYQKLIKKEDHKLLFTLSKNDIVYIPEEILTDEQIAEINWNDKRDIVPKLFVVKEMTPSRNEIVFQHLYKSDSIRVNGDEAKNILNTEKLEEQIKYGDTNMWKRCIKVDIDKLGTEIKPYWENNKIVL

SEQ ID NO: 23 - RNA, 14 nt, Acidovorax sp.
  source 1..14: mol_type = other RNA
gttgtgaattgctt

SEQ ID NO: 24 - RNA, 63 nt, Acidovorax sp.
  source 1..63: mol_type = other RNA
aagcaattcacaataaatttttaatgttgtgaaaacattcaaagcggcgcaagtcgctttttt

SEQ ID NO: 25 - RNA, 110 nt, synthetic construct
  source 1..110: mol_type = other RNA
  variation 1..29: note = Can be any sequence
nnnnnnnnnnnnnnnnnnnnnnnnnnnnngttgtgaattgcttaaagaagcaattcacaataaatttttaatgttgtgaaaacattcaaagcggcgcaagtcgctttttt

SEQ ID NO: 26 - RNA, 111 nt, synthetic construct
  misc_feature 1..111: note = source = /note="Description of Artificial Sequence: Syntheticpolynucleotide"
  source 1..111: mol_type = other RNA
gagcggacagcagcttcctatatctcgtacgttgtgaattgcttaaagaagcaattcacaataaatttttaatgttgtgaaaacattcaaagcggcgcaagtcgctttttt

SEQ ID NO: 27 - RNA, 111 nt, synthetic construct
  misc_feature 1..111: note = source = /note="Description of Artificial Sequence: Syntheticpolynucleotide"
  source 1..111: mol_type = other RNA
ccatgatatagacgttgtggctgttgtagtgttgtgaattgcttaaagaagcaattcacaataaatttttaatgttgtgaaaacattcaaagcggcgcaagtcgctttttt

SEQ ID NO: 28 - skipped

SEQ ID NO: 29 - protein, 1075 aa, Bacillus sp.
MDYRIGLDIGTNSVGWGVIRMQYNDLLERYEKQGIVDAGVRMFDKAEIPKTGASLAAPRREARSSRKRLRRRSQRKKAIRYLIILHELLSEDQLQQLYPLQKESIDIWDIRLESLDRVLNQTEWARLLIHLGQRRGFKSNRKSEYKEEETGKVLVNIQENQKALQQYRTVAEMWMKDAKFSQFDKKRNAPGEYLFSVSRYDLQNEIQTIFESQRNLGSPYATTDLEEEYISVWSKQLPFASGEDILKKVGYCSLERKERRIPKATYTFQYFILLDGLNKIRVGADARQLTTEERSILIEKILTRNDYFSKKSLPDLTYGDLRKWLALDSSLLFKDLTYDPNEKVSKVEKKVFANLKSLYELRKVVETSSNGQSFERIDYDTFGYALTVYKTDEDIRRYLKKPSNLAHKVYEEDLIERLLSLSYEKFGHLSLKAIQTILPYMEDGMMYTEAVQAAGYDITGLQSAKRTLLLPTIPADITNPVVRRALTQTRKVVNAIIKRYGSPLTIHIELARELSKDHQERQQILKNQQANYERNKGAISVLVENGILNPTGYDIVRYKLWKEQGERCAYSLKVIPPSVFFGELKRERNHIPTLEVDHILPYSQSFMDNYHNKVLVYSDENQKKGNRIPSQYLMAVSPEKWTKFEEYVSSNKGFSKQKRQYLLKKDYSSRERDIVKERHLVDTRYATRFMKNFIEKTLLFKESRSSSLTKRVQTVNGKITAHFRKRWGLEKERTETYLHHALDAIVVACTDQHMVTRVTEYYQERERNVRQPYFPWPWEGFRDELLNYLNRQPDSLEISQSIKQNLFLRDYLMVSRMPKHSVTGMSHKQTIRSKACVDEKGKVKTTKRVLLQDIKFDSNGDFKMIGKEQDMATYNAIKERFLSSGGNVKSAFTEPLHKPSKKGKGNVIRKVTVEDQTKSFVRDVNGGVAENGSLVRIDLFEKEGMYYVVPIYVGDTVLKQLPIKISASNRGYYKWVELDENYRFKFSLYAHDLIRIVTKDEDRFFYFSYFDNDGNRIKFLNINSPTGKNENRYGVRSIKLIEKYNVSTLGDISLVKSEERQLFQGMKKKVLNIIN

SEQ ID NO: 30 - RNA, 17 nt, Bacillus sp.
  source 1..17: mol_type = other RNA
gtcatagttccattaaa

SEQ ID NO: 31 - RNA, 83 nt, Bacillus sp.
  source 1..83: mol_type = other RNA
tttgatgttcctatgataagggccttgagcccgtggcgttggggatcgcctgcccgtttatacgggcttctccctacttactt

SEQ ID NO: 32 - RNA, 104 nt, synthetic construct
  misc_feature 1..104: note = source = /note="Description of Artificial Sequence: Syntheticpolynucleotide"
  source 1..104: mol_type = other RNA
gtcatagttccattaaaaaagtttgatgttcctatgataagggccttgagcccgtggcgttggggatcgcctgcccgtttatacgggcttctccctacttactt

SEQ ID NO: 33 - RNA, 134 nt, synthetic construct
  misc_feature 1..134: note = source = /note="Description of Artificial Sequence: Syntheticpolynucleotide"
  source 1..134: mol_type = other RNA
gagcggacagcagcttcctatatctcgtacgtcatagttccattaaaaaagtttgatgttcctatgataagggccttgagcccgtggcgttggggatcgcctgcccgtttatacgggcttctccctacttactt

SEQ ID NO: 34 - RNA, 134 nt, synthetic construct
  misc_feature 1..134: note = source = /note="Description of Artificial Sequence: Syntheticpolynucleotide"
  source 1..134: mol_type = other RNA
ccatgatatagacgttgtggctgttgtagtgtcatagttccattaaaaaagtttgatgttcctatgataagggccttgagcccgtggcgttggggatcgcctgcccgtttatacgggcttctccctacttactt

SEQ ID NO: 35 - skipped

SEQ ID NO: 36 - protein, 1068 aa, Bacillus sp.
MKYVLGLDIGIASCGWAVINQEKHRIEDLGVRIFDKAENPKDGKSLATPRRDARSTRRTLRRKKHRMQRIKILLVKHGLLSKTEIDHLYESATEIDVWYLRLNALERRLNPKEFARVLIHLAKRRGFKSNRKETTLSENGQILENISENLQIMEQQNYRTVGEMILKDKKFENHKRNKDGTYIGTVTRQQLKEEIQMIFNAQRLYKNDYATEEFESSYLEIWASQRPYASKDQIEKMIGYCTLEPKEKRVPKASWSFQYFVALQTINNLRLINKDRIEELSFEEKNQIMNLALEKSIVKYIDIRKLLSIPNEFHFNNLLYSADTVDTAVENKKCIEFKEYHSINKLYKQIYGKSVPNLLPIDYDTIACGLTIFKDDKDILAYLQNKYVNAKGKPISNLAKKTYDDTFIQALLTLNFSKMGHLSFKALKNIIPFLEEGLSYDKACEKAGYNFKGTSHAEKTKYLPVIPQNTNPVVHRALSQTRKVINAIIKKYGSPSAIHIETARELSKTFQERKEIDSMYQDNSKKNEHAIHKLKELGLINPSGINIVKFKLWNEQDGRCMYSGKYIEPHRLFEEGYTEVDHILPYSRSLDDSYNNKALTLGIENQRKGNKTPYEYIGKTSIWHEFETRVQSNKRINKKKQQKLLLQYFSYTREQEFIKRNLNDTRYATIYLSTLIQQHLIFSESSRKKKVHTVSGIITSHLRSRWGFNKDRKEGHIHHALDAVIVAVTSDHMIQRVTKYYKLKELNRNLQAKRMQFPEPWEGFRLELEARISPNTQQYLKRILFKNYADVNLSEIKPIFVSRMPKRSITGELHQETIRKLIGYNEKGKVLTAIKTKLEDIPFDANGDFPMYGKETDLYTYNAIKERYLSHKKDKRKSFQDPLYKPTKSGEIGPLIKSIKIMDTRTIVNPVNQGKGVVYNSKIARTDVFKKDEKYYLIPIYTIDLLKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLFEKYQVDVLGHYTKIKEEKRIGMVI

SEQ ID NO: 37 - RNA, 19 nt, Bacillus sp.
  source 1..19: mol_type = other RNA
gctatagttccataagaaa

SEQ ID NO: 38 - RNA, 115 nt, Bacillus sp.
  source 1..115: mol_type = other RNA
tttcttaagttactatagtaagggcaatgacccgtggcgtttggggatcgccttatcctggtatggatattctccccatgtgaaaagcacctaagcatagcgctatggtgctttt

SEQ ID NO: 39 - RNA, 172 nt, synthetic construct
  variation 1..29: note = Can be any sequence
  source 1..172: mol_type = other RNA
nnnnnnnnnnnnnnnnnnnnnnnnnnnnngctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 40 - RNA, 168 nt, synthetic construct
  misc_feature 1..168: note = source = /note="Description of Artificial Sequence: Syntheticpolynucleotide"
  source 1..168: mol_type = other RNA
gagcggacagcagcttcctatatctcgtacgctatagttccataagaaaaaagtttcttaagttactatagtaagggcaatgacccgtggcgtttggggatcgccttatcctggtatggatattctccccatgtgaaaagcacctaagcatagcgctatggtgctttt

SEQ ID NO: 41 - RNA, 168 nt, synthetic construct
  misc_feature 1..168: note = source = /note="Description of Artificial Sequence: Syntheticpolynucleotide"
  source 1..168: mol_type = other RNA
ccatgatatagacgttgtggctgttgtagtgctatagttccataagaaaaaagtttcttaagttactatagtaagggcaatgacccgtggcgtttggggatcgccttatcctggtatggatattctccccatgtgaaaagcacctaagcatagcgctatggtgctttt

SEQ ID NO: 42 - skipped

SEQ ID NO: 43 - protein, 1081 aa, Bacillus sp.
MQYVLGLDIGIASCGWAVINQEKERIEDLGVRIFDKAENPKDGKSLAAPRRDARSTRRTLRRKKHRMQRIKILLVKHGLLSQTELDHLYESATEVDVWNLRLDAIERKLNPKEFTRVLIHLAKRRGFKSNSKETTLSENGQILESISENQQIMEQKNYKTIGEMILKDKKFENHKRNKDGTYIGTVTRQQLQDEIQIIFNAQRLYKNNYATKEFESSYLEIWASQRPYASKDQIEKMIGYCTLEQKEKRVPRASWSFQYFVALHTINNLRLISKDRIEELSFKEKKQIMNLALEKPIVKYIDIRKLLSIPNELHFNSLLYSADTVDTTVENRKCIELKEYHSINKVYKQIYGKNALNLLPIDYDTIAYGLTIFKDDKDILEHLKNKYVNAKGKPINNLAKKTYDDTFIQALLTLNFSKMGHLSFKALKNIIPFLEEGLSYDKACEKAGYNFKGTSYTEQTKYLPVIPQNTNPVVHRALSQTKKVINAIIKKYGSPNAIHIETARELSKTFQERKEIDSMYQDNSKKNEHAIHKLKELGNINPSGINIVKFKLWNEQDGKCMYSGKYIEPHRLFEEGYTEVDHILPYSRSLDDSYNNKTLTLGIENQRKGNKTPYEYMGNTSIWDEYEIRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLCEIKPIFVSKMPKRSITGELHQETIRKFIGYNEKGKVLTAIKTKLEDIPFDANGDFPMYGKETDLYTYNSIKERYLSHKKDKRKSFQEPLYKPTKSGGIGPLIKSIKIMDTRTIVNPVNQGKGVVYNSKIARTDVFKKDDKYYLIPIYTIDLMKNILPQKAITAGKGYEDWITIDHSFTFLFSLFPNDLIKIVPSKNKEIKARSTSSKKEILLPSLIGYFKSVHSGTAGITVESHDGRFIANVGSKQLLLFEKYQVDVLGHYTKIKEEKRIGMATCNDNKKSTAFGSL

SEQ ID NO: 44 - RNA, 16 nt, Bacillus sp.
  source 1..16: mol_type = other RNA
gctatagttccataag

SEQ ID NO: 45 - RNA, 111 nt, Bacillus sp.
  source 1..111: mol_type = other RNA
cttaagttactatagtaagggcaatgacccgtggcgtttggggatcgcctcatccattacggatattctccccatgtgaaaagcacctaagcataaggctaaggtgctttt

SEQ ID NO: 46 - RNA, 160 nt, synthetic construct
  source 1..160: mol_type = other RNA
  variation 1..29: note = Can be any sequence
nnnnnnnnnnnnnnnnnnnnnnnnnnnnngctatagttccataagaaagcttaagttactatagtaagggcaatgacccgtggcgtttggggatcgcctcatccattacggatattctccccatgtgaaaagcacctaagcataaggctaaggtgctttt

SEQ ID NO: 47 - RNA, 161 nt, synthetic construct
  misc_feature 1..161: note = source = /note="Description of Artificial Sequence: Syntheticpolynucleotide"
  source 1..161: mol_type = other RNA
gagcggacagcagcttcctatatctcgtacgctatagttccataagaaagcttaagttactatagtaagggcaatgacccgtggcgtttggggatcgcctcatccattacggatattctccccatgtgaaaagcacctaagcataaggctaaggtgctttt

SEQ ID NO: 48 - RNA, 161 nt, synthetic construct
  misc_feature 1..161: note = source = /note="Description of Artificial Sequence: Syntheticpolynucleotide"
  source 1..161: mol_type = other RNA
ccatgatatagacgttgtggctgttgtagtgctatagttccataagaaagcttaagttactatagtaagggcaatgacccgtggcgtttggggatcgcctcatccattacggatattctccccatgtgaaaagcacctaagcataaggctaaggtgctttt

SEQ ID NO: 49 - skipped

SEQ ID NO: 50 - protein, 1404 aa, Chryseobacterium sp.
MKKTLGIDLGTNSIGWVIRNADLLDNQIEDFGVITFEKGVASEKGNEFPKVQKRTESRGKRRNYQSEKYRKFALLAFLIQKNMCPLTMDEFCNWKDYRKGKKREYPQSEEFLNWIRFDFNGDGLPDFHLFGKEKDDSYYVFRAFAADENHKNVFDNNPHILGRVLYQMVQRRGFKGRDEEEAKTMLVGSDKNGTKGRNDIEEYIEKYKTLGAALYYHQKDFGGRIKQRYNLRKDNENELKEICKIHQLSQEDYEKLWKAIIWQRPLRTQKGLVGNCIYEKNKKRVAVSHPLYEEYRTWVFINNLNIIPPFGEEKQNYISEKIYPLFYKSKPDFELSDIDKQLKKDGAKRTSKHNDKTKVLSVKLLKQFQDVFGEDWKQKLQWDINGDRNSQPEKKEKSLYTFEDLWHILLTFDGQENLKKFALEKLNLDDEKAIKFSKIKLQQGYATLSISAIKKILPYLQRGFLYSHAVYMANLYKMLGETTISETLTNHFSDEILKILENDDFNRKNSAIINSLISEMLNDDNRYYIADNRNLDKTEEQIVLKSITDNYGLETWGNFDEEKKMEIIDFVSSKYLEFLKKTYTEKGNLFIQPERIHDKIFNFLKETYHVSEDKIKYLWHPSEQENYAKADEYFEYSIGSKKYYVKEESTQNFLSRNPNAEFDGRQLKLLGNPEPLSKGFKNPMALKSLHKLKNLVNYLLQTGKIDEGTRVVIEIARELNDKNKRKAIENWQKDREKENEAFRKEIEVYKEQFPNINLIDENTLIRKIRLWHEQNKICLYTGKTIPFSELIIGNKYDFEHTIPASISFDNELKNLTISDSSYNRLYKGKKFPTQLSNYDSEQTINGESCNSILRNIEFIFGERIVEYKEIKGKTEKIVKWKKIDELEKQFDEWKKKASYASTKEIKDNCIVKYHTIKMDLDYLKSKLATFTITEYKAGWRNSQIRDTQIITKYALPYFKTLFKRVSVEKGGVTDIFKKVYKVQSRNSKKDRSVHSHHAQDAAILTLIPNAFHRERIIKAYENEIDNRTGKTYHEQPLDWENFSEKYILELQDKVLINNLTDNRTITQTYKTVRKRGKVVYDIDENGNSLKRVSKGDTIRGQLHGETFYGAIKQPVRDEDNKILFDENKKMILKDEIYLAVRKPLVYKKDANSPGFKTLDEVEKVIVDKGLFKMIKKQVEESDFKTALIDGVYMLNESGEKVNKIRRIRCFENGLKYTTAIKVHEHSFVSHKEYKQSTLATNGENTYCLFYKNDKGKAMKILSIVDLAELKLKNIQNLYNEPEFSSFEVGKGKNKYKIPLYSVLKSGDKVLFYKENIYELKDLEQKELSDRMFKMYQFEKDGRIKFRHHLAAGIDTELKKENPENSSVNFEEKQVFLRLSQGQWNFAIDGKDFEISLDGKINWKF

SEQ ID NO: 51 - RNA, 15 nt, Chryseobacterium sp.
  source 1..15: mol_type = other RNA
gttgtgaattgcttt

SEQ ID NO: 52 - RNA, 68 nt, Chryseobacterium sp.
  source 1..68: mol_type = other RNA
aaagcaattcacaataaggcttaaaagccgaagaaaatctttagtcctgcgtactccgtgggattttt

SEQ ID NO: 53 - RNA, 116 nt, synthetic construct
  variation 1..29: note = Can be any sequence
  source 1..116: mol_type = other RNA
nnnnnnnnnnnnnnnnnnnnnnnnnnnnngttgtgaattgctttaaagaaagcaattcacaataaggcttaaaagccgaagaaaatctttagtcctgcgtactccgtgggattttt

SEQ ID NO: 54 - RNA, 117 nt, synthetic construct
  misc_feature 1..117: note = source = /note="Description of Artificial Sequence: Syntheticpolynucleotide"
  source 1..117: mol_type = other RNA
gagcggacagcagcttcctatatctcgtacgttgtgaattgctttaaagaaagcaattcacaataaggcttaaaagccgaagaaaatctttagtcctgcgtactccgtgggattttt

SEQ ID NO: 55 - RNA, 117 nt, synthetic construct
  misc_feature 1..117: note = source = /note="Description of Artificial Sequence: Syntheticpolynucleotide"
  source 1..117: mol_type = other RNA
ccatgatatagacgttgtggctgttgtagtgttgtgaattgctttaaagaaagcaattcacaataaggcttaaaagccgaagaaaatctttagtcctgcgtactccgtgggattttt

SEQ ID NO: 56 - protein, 1092 aa, Bacillus sp.
MRYSIGLDIGTTSIGSAVINNDLQRFEHLGVRIFDAAENPKDGSSLSAPRRLARSSRKRLRRRKHRVERTKQILINKGLLTKTQVKNLYNSKNVNLDVWDIRVSGLDRKLFNDEFARVLIHFSKNRGFKSNRKSELKEDDNGAILSAVKENKELMEEKGYRTIAEMLVLDERYEGTKRNKDGDYSHVVSRSDIENEIRLLFQKQREYGHPFAIEENEEAFLAIWSSQRPFATKDDIVKKIGTCTLEPREKRAPKSTYTFERFRALDKLNRLRILSTTTPSRPLTNEERDSILNSLFSKKEVKYKELRKMLKLTDDQRFNEIYYSPDETIEKTENRVFLSSESQYKIKKIIEKTESKNMLSTYCPIDYDTIGYALTVFKDDKDIQHYLQNRYVDSKGKAISNMANREYNLELIEELLGLSFSKFGHLSLKALNNILPYMEEGEPYHIACEMAGYQFSQRLTKEKHRLLPPIPVDEIPNPVVVRALTQVRKVLNSIIKKYGPPSDIYIELAREMGKPFKERKSLEREFNENRQVNEKAKAHISELYRVPNDPRPHDILKFKLWKEQNGICPYSFKPISVDYLFNIGYTEVDHIIPYSRSFDDSNGNKVLVLTNENRNKLNRTPYEWFGHDENRWGDFVSFVRTMKVGKKKKDMLLKKNFDEEQEEQILSRNLNDTRYITRYIKSFIEDNLEFRTEENKKQYVHTVNGGYTSLMRKRWGLNKDRRGNDLHHAVDAAIIAVSLPFKHKVNTYFKRQEIGLSNLSNNKKDIFPEPWRNFIKELEARMIQDPEKMKTALESLELETYGEIFLNKLKPIFVSRMPKHSIKGQIHEETIRRVRGLTEEGFLVTVKKTRLDQIPFDKNGDFPMYGKETDIKTYMAIKQRYLEYGQDKQKAFAIPLRKPSKNPENAPIVRSVKIEGKANRVVMLDDKAAADNASIARTEVFRHKETGEYYVTPVYVADIVSNKIPDRLITLKKPYSEWDRITDEYEYLFSLYNNDLIKIVLPKEKETKKYTGGNHLWQEGFFYFKGVDSSNASIKIIDHLNSFEVRIGIRRLIAFEKYQVNPLGEINKVHGEKRPGELLNEEEIKENRKNIS

SEQ ID NO: 57 - RNA, 23 nt, Bacillus sp.
  source 1..23: mol_type = other RNA
gccataattcctctgtaaaactt

SEQ ID NO: 58 - RNA, 112 nt, Bacillus sp.
  source 1..112: mol_type = other RNA
aaggtttatagagttattatggtaaggcaatatgccgtggcgttggggatcgcctatgtccggttttaccggatctccctagaggtgactaactttggttagtcgccttttt

SEQ ID NO: 59 - RNA, 168 nt, synthetic construct
  variation 1..29: note = Can be any sequence
  source 1..168: mol_type = other RNA
nnnnnnnnnnnnnnnnnnnnnnnnnnnnngccataattcctctgtaaaacttaaagaaggtttatagagttattatggtaaggcaatatgccgtggcgttggggatcgcctatgtccggttttaccggatctccctagaggtgactaactttggttagtcgccttttt

SEQ ID NO: 60 - RNA, 169 nt, synthetic construct
  misc_feature 1..169: note = source = /note="Description of Artificial Sequence: Syntheticpolynucleotide"
  source 1..169: mol_type = other RNA
gagcggacagcagcttcctatatctcgtacgccataattcctctgtaaaacttaaagaaggtttatagagttattatggtaaggcaatatgccgtggcgttggggatcgcctatgtccggttttaccggatctccctagaggtgactaactttggttagtcgccttttt

SEQ ID NO: 61 - RNA, 169 nt, synthetic construct
  misc_feature 1..169: note = source = /note="Description of Artificial Sequence: Syntheticpolynucleotide"
  source 1..169: mol_type = other RNA
ccatgatatagacgttgtggctgttgtagtgccataattcctctgtaaaacttaaagaaggtttatagagttattatggtaaggcaatatgccgtggcgttggggatcgcctatgtccggttttaccggatctccctagaggtgactaactttggttagtcgccttttt

SEQ ID NO: 62 - skipped

SEQ ID NO: 63 - protein, 1150 aa, Enterococcus sp.
MYSIGLDLGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFILTELMTKEFARFGVNDIAKLLGVKKEQLSGWRLDKKGKPEIHTLKGYRNWRKIFAEAGIDLATLPTETIDCLAKVLTLNTEREGVENTLAFELPELAEPVKSLVLDHYKELSQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIK

SEQ ID NO: 64 - RNA, 19 nt, Enterococcus sp.
  source 1..19: mol_type = other RNA
gttattgtactctcaataa

SEQ ID NO: 65 - RNA, 67 nt, Enterococcus sp.
  source 1..67: mol_type = other RNA
ttattgagaatctacaataataaggcatcttgccgaatttaccgccctacatatgtagggcggtttt

SEQ ID NO: 66 - RNA, 119 nt, synthetic construct
  variation 1..29: note = Can be any sequence
  source 1..119: mol_type = other RNA
nnnnnnnnnnnnnnnnnnnnnnnnnnnnngttattgtactctcaataaaaagttattgagaatctacaataataaggcatcttgccgaatttaccgccctacatatgtagggcggtttt

SEQ ID NO: 67 - RNA, 120 nt, synthetic construct
  misc_feature 1..120: note = source = /note="Description of Artificial Sequence: Syntheticpolynucleotide"
  source 1..120: mol_type = other RNA
gagcggacagcagcttcctatatctcgtacgttattgtactctcaataaaaagttattgagaatctacaataataaggcatcttgccgaatttaccgccctacatatgtagggcggtttt

SEQ ID NO: 68 - RNA, 120 nt, synthetic construct
  misc_feature 1..120: note = source = /note="Description of Artificial Sequence: Syntheticpolynucleotide"
  source 1..120: mol_type = other RNA
ccatgatatagacgttgtggctgttgtagtgttattgtactctcaataaaaagttattgagaatctacaataataaggcatcttgccgaatttaccgccctacatatgtagggcggtttt

SEQ ID NO: 69 - skipped

SEQ ID NO: 70 - protein, 1150 aa, Enterococcus sp.
MYSIGLDLGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGNYQLNVFKVSAYADELATILKTQQALYPNELTDDWIALFVQPGIAEDAGLIYRKRPYYHGPGNEANNSPYGRWSDFQKTGQPAANIFDKLIGKDFQGELRASGLSLSAQQYNLLNDLTNLKIDGEQPLSPTQKEFILTELMTKEFARFGVNDIAKLLGVKKEQLSGWRLDKKGKPEIHTLKGYRNWRKIFAEAGIDLATLPTETIDCLAKVLTLNTEREGVENTLAFELPELAEPVKSLVLDHYKELSQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDAWMAGAFKKINGKFSNWDEYQKWVESRPFSRKKANNLLETRNIFDSEQVQNFLSRNLNDTRYASRLVLNTLQSFFENQDTIVRVVNGSFTHTLRKKWGADLDKTRETHHHHAIDASLCAVTPFVKVSRYHYAVNEETGEKFMREIDVETGEILDEIPYREYKKAKHYERKTYQVKWSNFREQLKPLTIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMMPAENQFKQKPYNNGAINLNIAKYGKEGNKLRKFNTDILGKKHHLSYEKEPKNIIK

SEQ ID NO: 71 - RNA, 19 nt, Enterococcus sp.
  source 1..19: mol_type = other RNA
gttattgtactctcaataa

SEQ ID NO: 72 - RNA, 67 nt, Enterococcus sp.; identical to SEQ ID NO: 65
  source 1..67: mol_type = other RNA

SEQ ID NO: 73 - RNA, 119 nt, synthetic construct; identical to SEQ ID NO: 66
  variation 1..29: note = Can be any sequence
  source 1..119: mol_type = other RNA

SEQ ID NO: 74 - RNA, 120 nt, synthetic construct; identical to SEQ ID NO: 67
  misc_feature 1..120: note = source = /note="Description of Artificial Sequence: Syntheticpolynucleotide"
  source 1..120: mol_type = other RNA

SEQ ID NO: 75 - RNA, 120 nt, synthetic construct; identical to SEQ ID NO: 68
  misc_feature 1..120: note = source = /note="Description of Artificial Sequence: Syntheticpolynucleotide"
  source 1..120: mol_type = other RNA

SEQ ID NO: 76 - protein, 1053 aa, Staphylococcus sp.
MKRHYILGLDIGITSVGYGIIDYETREVIDAGVRLFKEANVENNEGRRSKRGARRLKRRRKHRLQSVKKLLFDYDLLTNHSELSGINPYEARVKGLSQNLSEVEFSGALLHLAKRRGVHNVNEVEEDTRNELSTKEQISRNSKALEEKYVAELQLERLKTDSEVRGAINRFKTSDYVKEAKQLLKVQKEYHQLDQSFIDTYIDLLETRRTYYEGPGKGSPFGWKDIKEWYEMLIGHCTYFPEELRSVKYAYNADLYNALNDLNNLVISRDDNEKLAYYEKFQIIENVFKQKKKPTLKQISKEIFVNEEDIKGYRVTSTGKPEFTKFKIYHDIKGIKERKEIIENAEVLDQIAEILTIYQSSEDIQEELAKLNSELTQEEIEQISKLTGYTGTHSLSLKAINLILDELWHTSDNQMAIFNRLKLVPKKMDLSQQKEIPTTLVDDFILSPVVKRSFIQSIKVINAIIKKYGLPSDIIIELAREKNSKDAQKLINEMQKRNRQTNERIEEIIRTTGKENAKYLIEKIKLHNMQEGKCLYSLEAIPLEDLLNNPFNYEVDHIIPRSVSFDNSFNNKVLVKQEENSKKDNRTPFQYLSSSDSKMDYETFKKHILNLSKGKDRISKKKKVYLLEERDINRFSVQKDFINRNLVDTRYATRELMTLLRSYFSVNNLDVKVKSINGGFTSFLRRKWKFKKERNQGYKHHAEDALIIANADYVFKEWKKLDRANKVMENQTVEENQAESMPEIETEQEYKEIFITPHQIQHIKDFKDYKYSHRVDKKSNRELVNDTLYSTRKDDKGNTLIVNNLNGLYDKDNDKLKKLMNQSPEKLLMYHHDPQTYQKLKLIMEQYGGEKNPLYKYHEETGNYLTKYSKKDNGPVIKKIKYYGNKLNVHLDITDDYPNSRNKVVKLSLKPFRFDVYLDNGVYKFVTIKNLDVIKKEDYYEVNSKCYKEAKKLKQISDQAEFIASFYNNDLIKVNGELYRIIGVNNDLLNRIEVNMVDITYKEYLETMNDKRTPRIFKAITGKTQSIKKYSTDILGNLYEVKSKQNPQMIMKR

SEQ ID NO: 77 - RNA, 17 nt, Staphylococcus sp.
  source 1..17: mol_type = other RNA
gttttagtactctgtaa

SEQ ID NO: 78 - RNA, 64 nt, Staphylococcus sp.
  source 1..64: mol_type = other RNA
ttacagaatctactaaaacaagactatatatcgtgtttatcccatcaatttattgatgggattt

SEQ ID NO: 79 - RNA, 114 nt, synthetic construct
  source 1..114: mol_type = other RNA
  variation 1..29: note = Can be any sequence
nnnnnnnnnnnnnnnnnnnnnnnnnnnnngttttagtactctgtaaaaagttacagaatctactaaaacaagactatatatcgtgtttatcccatcaatttattgatgggattt

SEQ ID NO: 80 - RNA, 115 nt, synthetic construct
  misc_feature 1..115: note = source = /note="Description of Artificial Sequence: Syntheticpolynucleotide"
  source 1..115: mol_type = other RNA
gagcggacagcagcttcctatatctcgtacgttttagtactctgtaaaaagttacagaatctactaaaacaagactatatatcgtgtttatcccatcaatttattgatgggattt

SEQ ID NO: 81 - RNA, 115 nt, synthetic construct
  misc_feature 1..115: note = source = /note="Description of Artificial Sequence: Syntheticpolynucleotide"
  source 1..115: mol_type = other RNA
ccatgatatagacgttgtggctgttgtagtgttttagtactctgtaaaaagttacagaatctactaaaacaagactatatatcgtgtttatcccatcaatttattgatgggattt

SEQ ID NO: 82 - skipped

SEQ ID NO: 83 - protein, 1052 aa, Staphylococcus sp.
MVTKYILGLDIGITSVGYGIINYEDKTIIDAGVRLFPEANVENNEGRRSKRGARRLKRRRIHRLDRIKQLLSEYNLVDLDNIPQSPSPYEIRVKGLREELSKDELVIALLHIAKRRGIHNVEAVDETQDEGNELSTKEQLAKNNNLLKDKYVCELLLERLKDGKVRGEKNRFKTTDIIKEVKQLLETQKEAHQLDDDFINRYIDLIETRREYFEGPGKGSPFGWGGDLKKWYETLMGHCTYFPNELRSVKYSYSADLFNALNDLNNLVIQREGNSKLEYHEKYHIIENVFKQKKKPTLKQIANEIGVSPDDIKGFRINKSGKETFTEFKLYHDLKKVLIDQSILENVQLLDQIAEILTIYQDKESIINELNQLSEIINEQDKESISNLSGYNGTHRLSLKCINLVIEELWHTSRNQMEIFTYLNIKPKKIDLAKTNKIPKNMIDEFILSPVVKRTFGQAINVINKVIEKYGVPEDIIIELARESNSKDKQKFINSLQKKNETTRKRINEIIGQYGNQNAKRLVEKIRLHDEQEGKCLYSLESIPLEDLINNPQYYEVDHIIPRSVSFDNSYQNKVLVKQTENSKKSNRTPYQYFNSGETKLSYNQFKQHVLNLSKSKDRISKKKKEYLLEERDINKYEVQKEFINRNLVDTRYATRELTNYLKAYFSANDMDVKVKTINGSFTDYLRKVWKFKKERNHGYKHHAEDALIIANADFLFKENKKLKKANAILEQPSLDNGKSDATVENDNEYVETFSIPKQVNDIKEFRDFKFSHRVDKKPNRQLINDTLYSTRKIENHTFIVSPITNIYSKDNDELKKKFNKNPEKFLMYQHDPKTFEKLEVIMKQYANEKNPLAKYHEETGEYLTKYSKKNNGPIVKTIKVLGDKVGKHLDVTHKYKYSNSKIVKKTINPYRFDVYLTDKGYKFITISYLDVLKKDNYYYILKEKYEELKIKKSISDTDQFIGSFYYNDLIKINDQIFKVVGVNNDLLNRIELDLLDISYKEYCKINNIKTNRIIKGITKKITNIEKFSTDVLGNLYKAHSNHPQLIFKQRD

SEQ ID NO: 84 - RNA, 17 nt, Staphylococcus sp.
  source 1..17: mol_type = other RNA
gttttagtactctgtaa

SEQ ID NO: 85 - RNA, 64 nt, Staphylococcus sp.; identical to SEQ ID NO: 78
  source 1..64: mol_type = other RNA

SEQ ID NO: 86 - RNA, 114 nt, synthetic construct; identical to SEQ ID NO: 79
  variation 1..29: note = Can be any sequence
  source 1..114: mol_type = other RNA

SEQ ID NO: 87 - RNA, 115 nt, synthetic construct; identical to SEQ ID NO: 80
  misc_feature 1..115: note = source = /note="Description of Artificial Sequence: Syntheticpolynucleotide"
  source 1..115: mol_type = other RNA

SEQ ID NO: 88 - RNA, 115 nt, synthetic construct; identical to SEQ ID NO: 81
  misc_feature 1..115: note = source = /note="Description of Artificial Sequence: Syntheticpolynucleotide"
  source 1..115: mol_type = other RNA

SEQ ID NO: 89 - protein, 1129 aa, Streptococcus sp.
MSNGKILGLDIGVASVGVGIIDAKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILEAQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDTIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKEKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDAAWSFREMKDYVLKQKRLGKKKREYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKTNISIYKVRTDVLGNKFFIKKEGDKPKLDFKNNNK

SEQ ID NO: 90 - RNA, 16 nt, Streptococcus sp.
  source 1..16: mol_type = other RNA
gtatttgtactctcaa

SEQ ID NO: 91 - RNA, 68 nt, Streptococcus sp.
  source 1..68: mol_type = other RNA
ttgcagagcctacaaatataaggcttcatgccgaattcaagcaccccatgtttacatggggtgctttt

SEQ ID NO: 92 - RNA, 117 nt, synthetic construct
  variation 1..29: note = Can be any sequence
  source 1..117: mol_type = other RNA
nnnnnnnnnnnnnnnnnnnnnnnnnnnnngtatttgtactctcaaaaagttgcagagcctacaaatataaggcttcatgccgaattcaagcaccccatgtttacatggggtgctttt

SEQ ID NO: 93 - RNA, 118 nt, synthetic construct
  misc_feature 1..118: note = source = /note="Description of Artificial Sequence: Syntheticpolynucleotide"
  source 1..118: mol_type = other RNA
gagcggacagcagcttcctatatctcgtacgtatttgtactctcaaaaagttgcagagcctacaaatataaggcttcatgccgaattcaagcaccccatgtttacatggggtgctttt

SEQ ID NO: 94 - RNA, 118 nt, synthetic construct
  misc_feature 1..118: note = source = /note="Description of Artificial Sequence: Syntheticpolynucleotide"
  source 1..118: mol_type = other RNA
ccatgatatagacgttgtggctgttgtagtgtatttgtactctcaaaaagttgcagagcctacaaatataaggcttcatgccgaattcaagcaccccatgtttacatggggtgctttt

SEQ ID NO: 95 - skipped

SEQ ID NO: 96 - protein, 1359 aa, Pediococcus sp.
MEKVPYNIGLDIGTSSIGFAATDNLNKPIRAKGKTVIGVRLFEEGKTAADRRGFRTTRRRLSRRKWRLRLLDEIFDKEMAKVDNTFFARLKESNLSPKDANKKYLGSLLFPEKKDFKFYEDYPTIYHLRYALMHEKRQFDIREVYLAMHHIIKYRGNFLNSAPMNSFKTQDFDFVAKFKKLNELFESIDAEHETKFDIENISKFRDIMLNQDIRKLDRKKQAAKILILDSTDKTAKKINNKIATAVANSALGYKFALDAILKLDVEESKDWSISLNDEEIDSILDNLTSDLDAERIEIIEILRDLYSHIALNEIVPNGQSLSKSMMDKYDKHHADLDVLKKVISNMDDRKKAKSLKNIYNQYVGKTNDKVLDKDEFYKQIQKNLDKSEDAMKIVNEIELDQFMPKQRTSQNGVIPHQLHQKELDEIIENQKQYYPFLAEPNPNEKRKPHAQFKLDELIAFKIPYYVGPLITKEEQQAQSGAKFAWMKRKQDGVITPWNFDEKVDRMASANEFIRRMTTKDTYLLGEDVLPDESLIYQKFKVLNELNNVKVNDKKLTVADKQDIFNDLFKKQKTVSVSKLQKYFVTEKHYLTEPTIKGLSDTKKFSNSLSTYIDFEKIFGNEILADQNKQNDLEKIIEWSTIFEDRKIFEDKLHEIEWLTEKQIKAIRRYRGWGRLSKKLLVDLRNNEGKSILDELWRTNDNFMQIQAREEFAKSIVEANQKLMNLGGAASVQNTVESTLEDAYTSPQNKKAIRQVIKVVEDIVKAVGYAPEKITIEFTRGADKNSRRTQNRQKQIMEVYKTAAKEIVDATLKGQLENEEKLTDKLYLYFTQLGKDIYSGETINIDQLNNYDIDHILPQAFIKDDSLDNRVLTSRDLNNGKSDSVPVKQFGANMKSFWMRLQAHGLISKRKLNNLMTDPDSIGKYTMQGFVRRQLVETSQVIKLTANILGAVYGENTDIVEIPAKLTHQMREKFNLYKVREVNDYHHAFDAYLTTFVGNYLFKRYPKLRPYFVYGDFKMTDNALKGMRRFNFLHDLKDDEVLVDNETGEVLWEGQKSIEELKKIYGYKFMLTTHEAYINNGAMYDQTVYPAKSNKKLIPSKNNRPTNIYGGFSGNKDAYLAIVKILGKKGDTYKVVGVPRRFSDELLNAYNDDYSEYLNKLHDVLVTQFTKKQRNKKTGKIIKKIENFEIVVGKVNYRQRIIDRNQSFMLGSSTYKYNTKQLVLTESSMKILSNFKHASDDNLNLVYDEILEKVNESFELYDKNGFRKKLNNNIDKFRKLPCKSIFEKNKLISVGKCEILFQILNGLHANATMGDLKGIGFSTPFGFMQDASGIKLNKDSMLLYQSPTGLFERKVKLSDL

SEQ ID NO: 97 - RNA, 14 nt, Pediococcus sp.
  source 1..14: mol_type = other RNA
gtttcagaagagtg

SEQ ID NO: 98 - RNA, 111 nt, Pediococcus sp.
  source 1..111: mol_type = other RNA
cattctgttttgaaatcaaacaacgctttacgcggagtttacacatctgtcccattatatgggcattacataataaaagaggaatcacctttaaggttgattcctcttttt

SEQ ID NO: 99 - RNA, 158 nt, synthetic construct
  source 1..158: mol_type = other RNA
  variation 1..29: note = Can be any sequence
nnnnnnnnnnnnnnnnnnnnnnnnnnnnngtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 100 - RNA, 159 nt, synthetic construct
  misc_feature 1..159: note = source = /note="Description of Artificial Sequence: Syntheticpolynucleotide"
  source 1..159: mol_type = other RNA
gagcggacagcagcttcctatatctcgtacgtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 101 - RNA, 159 nt, synthetic construct
  misc_feature 1..159: note = source = /note="Description of Artificial Sequence: Syntheticpolynucleotide"
  source 1..159: mol_type = other RNA
ccatgatatagacgttgtggctgttgtagtgtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 102 - skipped

SEQ ID NO: 103 - protein, 1488 aa, Weissella sp.
MAKQKYTVGLDIGTNSVGWAVINKDFKLVSGKKHINDNGKQKRSRTNLWGVRLFDAADTAADRRLKRGMRRRIARRKERLNYLRGIFQADILAFDDSFFIRMDESFLQDDDKQATAFSYRDQSGAMQTRVVTEKEAVKYPLFNGKSGSGETYTDESAYYNQYPTIYHLRQRLIDNPAQADLRLVYLAMHHILKYRGHFVNQGQTFDLGNINIAGNLTSALDKLDEASSFKFGLADVDADQANAILKNKQWSASKKAYELNTLYEIIQDTVYRRENETQAVAYDSLTVKQQEKWLAEKQKQVKAFLTGIVGNTISPKDIFANKDYDRKQNEDFPEKIKYSNENFEEQIGELEKYLDETEVAAIVAGKDVYESLVLSNILTKSTLSGSMIEKYNVHGTQLKSLKSFSRKVSAEFYDKLFNVVKDEKGKPQIGVYAQYIDGVGNPAKRLAREDFYDALKKVFESEFKGLTFPAGEKGIDFTKTDLSADRMAFIREMNEAINLENYLPKQRQADNGAIPYQVHEHELIRIIENQKQYYPFLGDKVQVTYEDESGQTQVRSEYKIQVLFKFRIPYYVGTLAKNSGWVNEDGKKLVARNVAAKNSWVVRNSDERVTPWNFEQVINKEASSINFIERMTNFDTYLPNEKVLPKNSLLYQEFIVNNELISSGYYLNGRKEYFLPEQRQRIITRLFKRYRKVSAKQMLDFLKNEYQIKLDDDPKKLFGLDTFVKVPSYNGSLSTVVDLTNKMGISEDLIANYPERFEEIIKWQTIFEDKKILKKTIREVNHNKWSGMLTAEQVNKLSKRHYTGWGRLSQKLLDGVKTSQGRTIIESLREGICDNFMRLIEDEKIAEFIANAQVAGAKDGVLAYDLVDQLPGSPAIKKGIWQSLRVLQELEHYLGRDAIGKVVIEMSRDDESSRRTKARKQQLEEFYKKFKESTGSDVTAELKRELSEKDAKEIDDEKVFLYFLQNGKSMYSGDQLYLSRLADYQVDHIVPQTYIKDDSLDNKVLVTQRDNQNKGGDTPSHTVVTRMNSYWDMLAKNGQVSPRKLANLKKGTITLKQREGFINRQLVENRQIIKHVANILTNYYTGTDTLVLTPKSGLTSQLRSGLIYELNPAFDEAKALDRGKAYQVERYTTVKLHDRFVKNRKLNDYHHAHDAYLNAFVAQYVYQEHPEWKNAWVYGKYPRNGQADFGKWATQRKQKSLQLLSSMANDVWNLEDPDTMEKTILNRDETFEQMRQTLCYRNINIVKKLETQTGKFGDESVYKKGNKADHYSLGLKRKYPPQKYGGTKGAISAVTALVKDNSGRVIPVSISASDYDSYQNASDKLAWLLMRKKNIAEILVASLPKYTKYELPSGALRLLASYQEAQSAVELPMLNLGLMDDEAKVLNLYDQLAQFIADNKLFTDKKIALLKGEMRVAFEGLEEFKDKQKVIDELLGVTNGSNQGLQALNSIGLGTSNQRLKSGNTMTNGVTLINESVTGLYSTRTTYN

SEQ ID NO: 104 - RNA, 22 nt, Weissella sp.
  source 1..22: mol_type = other RNA
gttttagtgtcatgttgaatag

SEQ ID NO: 105 - RNA, 70 nt, Weissella sp.
  source 1..70: mol_type = other RNA
ctattcaacatggcaagttaaaataagctttatgcgtattcaaacttttgttaaggcgacatcgcctttt

SEQ ID NO: 106 - RNA, 125 nt, synthetic construct
  variation 1..29: note = Can be any sequence
  source 1..125: mol_type = other RNA
nnnnnnnnnnnnnnnnnnnnnnnnnnnnngttttagtgtcatgttgaatagaaagctattcaacatggcaagttaaaataagctttatgcgtattcaaacttttgttaaggcgacatcgcctttt

SEQ ID NO: 107 - RNA, 126 nt, synthetic construct
  misc_feature 1..126: note = source = /note="Description of Artificial Sequence: Syntheticpolynucleotide"
  source 1..126: mol_type = other RNA
gagcggacagcagcttcctatatctcgtacgttttagtgtcatgttgaatagaaagctattcaacatggcaagttaaaataagctttatgcgtattcaaacttttgttaaggcgacatcgcctttt

SEQ ID NO: 108 - RNA, 126 nt, synthetic construct
  misc_feature 1..126: note = source = /note="Description of Artificial Sequence: Syntheticpolynucleotide"
  source 1..126: mol_type = other RNA
ccatgatatagacgttgtggctgttgtagtgttttagtgtcatgttgaatagaaagctattcaacatggcaagttaaaataagctttatgcgtattcaaacttttgttaaggcgacatcgcctttt

SEQ ID NO: 109 - skipped

SEQ ID NO: 110 - protein, 1337 aa, Enterococcus sp.
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 111 - RNA, 17 nt, Enterococcus sp.
  source 1..17: mol_type = other RNA
gttttagagtcatgttg

SEQ ID NO: 112 - RNA, 68 nt, Enterococcus sp.
  source 1..68: mol_type = other RNA
caacatagcaagttaaaataaggttttaaccgtaatcaactgtaaagtggcgctgtttcggcgctttt

SEQ ID NO: 113 - RNA, 118 nt, synthetic construct
  variation 1..29: note = Can be any sequence
  source 1..118: mol_type = other RNA
nnnnnnnnnnnnnnnnnnnnnnnnnnnnngttttagagtcatgttgaaagcaacatagcaagttaaaataaggttttaaccgtaatcaactgtaaagtggcgctgtttcggcgctttt

SEQ ID NO: 114 - RNA, 119 nt, synthetic construct
  misc_feature 1..119: note = source = /note="Description of Artificial Sequence: Syntheticpolynucleotide"
  source 1..119: mol_type = other RNA
gagcggacagcagcttcctatatctcgtacgttttagagtcatgttgaaagcaacatagcaagttaaaataaggttttaaccgtaatcaactgtaaagtggcgctgtttcggcgctttt

SEQ ID NO: 115 - RNA, 119 nt, synthetic construct
  misc_feature 1..119: note = source = /note="Description of Artificial Sequence: Syntheticpolynucleotide"
  source 1..119: mol_type = other RNA
ccatgatatagacgttgtggctgttgtagtgttttagagtcatgttgaaagcaacatagcaagttaaaataaggttttaaccgtaatcaactgtaaagtggcgctgtttcggcgctttt

SEQ ID NO: 116 - skipped

SEQ ID NO: 117 - protein, 1340 aa, Enterococcus sp.
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLQELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEDSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 118 - RNA, 15 nt, Enterococcus sp.
  source 1..15: mol_type = other RNA
gttttagagctatgc

SEQ ID NO: 119 - RNA, 70 nt, Enterococcus sp.
  source 1..70: mol_type = other RNA
gcatagcaagttaaaataaggctttgtccgtcatcagcttttttaaagcagcgctgttctcggcgctttt

SEQ ID NO: 120 - RNA, 118 nt, synthetic construct
  variation 1..29: note = Can be any sequence
  source 1..118: mol_type = other RNA
nnnnnnnnnnnnnnnnnnnnnnnnnnnnngttttagagctatgcaaaggcatagcaagttaaaataaggctttgtccgtcatcagcttttttaaagcagcgctgttctcggcgctttt

SEQ ID NO: 121 - RNA, 119 nt, synthetic construct
  misc_feature 1..119: note = source = /note="Description of Artificial Sequence: Syntheticpolynucleotide"
  source 1..119: mol_type = other RNA
gagcggacagcagcttcctatatctcgtacgttttagagctatgcaaaggcatagcaagttaaaataaggctttgtccgtcatcagcttttttaaagcagcgctgttctcggcgctttt

SEQ ID NO: 122 - RNA, 119 nt, synthetic construct
  misc_feature 1..119: note = source = /note="Description of Artificial Sequence: Syntheticpolynucleotide"
  source 1..119: mol_type = other RNA
ccatgatatagacgttgtggctgttgtagtgttttagagctatgcaaaggcatagcaagttaaaataaggctttgtccgtcatcagcttttttaaagcagcgctgttctcggcgctttt

SEQ ID NO: 123 - protein, 1327 aa, Enterococcus sp.
MKKNYTIGLDIGTASVGWAVLTEDYDLVKRKMKISGNTQKKAVKKNFWGVRLFEQGETAEGRRLKRTTRRRIARRRQRIQYLRTIFDEAMNQVDANFFARLDESFSITDEKENERHPIFGNVAEEVAYHEQFRTIYRLREVLANSSEQADLRLIYLALAHIIKFRGHFLIEGELNTENSSVSGTFEQFIKVYNETFNVEKVLELTVDLDEIAKQKVSRMKRAELILSLFPEEKSTGDFAQFIKMIVGNQGNVKKTFSLNEDAKIQFSKEEYEENLETLLAEIGEDFRGVFDAAKSVYDAISLANILKVTDAATRAKLSSSMVARFKEHKEDLKALKQFVRDNLPDEYDDLFKNKKVAGYAGYIDGDATQEEFYKYLKKALAKTTGAEYFLAKIEQEDFLRKQRTFDNGVIPYQLHLEELKAIIRNQKPYYPFLDEEKISQLMTFRIPYYVGPLAQGQGNFAWLTRKESGKITPWNLNEKVDIEKSATDFVERMTNNDSYLPMEKVLPKHSLLYEKFTVYNELTKVRYMDDNGRVQNFSSKEKQQIVNDLFKQQRKVKKEILEAFIKNEYGIENPKVEGIEKAFNASLGTYHDLVKLGIRPALFEQPEYEQQFEQIVKILTVFEDRKMRRKQLEQFSDLLTEDEQKQLERKHYKGWGRLSAKLIHGIVDQKTQKTILDYLIDDDDLPRNRNRNFMQLINDENLSFKEEIEKIAFDNDKSTEEIVQELAGSPAIKKGILQSLKIVEEIIEIMGELPTNIVVEMARENQTTAQGNRASQARMKYLEESIKKLGSSILEDEPISKDANLLRNDRLFLYYLQNGRDMYTGDELDINNLSSYDIDHIIPQSFVKDDSIDNRVLTTQRINRGKSNTVPAESVVKDMRATWERLYASNLISKKKLNNLMKAVNGGLTEEDKAYFIQRQLVETRQITKNVAQILHQKYNNEQSSEKPVRVVTLKSALASQFRKDFSLYKIRELNDYHHAQDAYLNGVIAQALLKVYPKLEPEFVYGEYQKVSIRALNKATAKKETYSNIMKFFTNDEVLTNKETGEVLWNRQRDIKTIKKVMNYHQMNIVKKVEIQTGRFTKESIQPKGPSKKLIARKNNWAPVNYGGFDSPTVAYSVIITHEKGKAAKVVQQLVGIKILERQAFEQNEVAFLEGKGFIHPKVQLKLPKYSLYQFADGRRRLLASADEAQKGNQMVLPTELIELLYHAKHVNDSSGESLTYLENHRTKFAELLEVILQFTNRYVGAEDRQKTVRDLYEKNQDADMKELAPSFVQLLQLNKQGAPASFKFFGETIERSRYKNMTELNKATFINQSITGLYETQRRLV

SEQ ID NO: 124 - RNA, 15 nt, Enterococcus sp.
  source 1..15: mol_type = other RNA
gttttagagctatgc

SEQ ID NO: 125 - RNA, 66 nt, Enterococcus sp.
  source 1..66: mol_type = other RNA
gcatagcaagttaaaataaggcttagtccgtaaacaaactttggcactgtattcggtgcttttttt

SEQ ID NO: 126 - RNA, 114 nt, synthetic construct
  source 1..114: mol_type = other RNA
  variation 1..29: note = Can be any sequence
nnnnnnnnnnnnnnnnnnnnnnnnnnnnngttttagagctatgcaaaggcatagcaagttaaaataaggcttagtccgtaaacaaactttggcactgtattcggtgcttttttt

SEQ ID NO: 127 - RNA, 115 nt, synthetic construct
  misc_feature 1..115: note = source = /note="Description of Artificial Sequence: Syntheticpolynucleotide"
  source 1..115: mol_type = other RNA
gagcggacagcagcttcctatatctcgtacgttttagagctatgcaaaggcatagcaagttaaaataaggcttagtccgtaaacaaactttggcactgtattcggtgcttttttt

SEQ ID NO: 128 - RNA, 115 nt, synthetic construct
  misc_feature 1..115: note = source = /note="Description of Artificial Sequence: Syntheticpolynucleotide"
  source 1..115: mol_type = other RNA
ccatgatatagacgttgtggctgttgtagtgttttagagctatgcaaaggcatagcaagttaaaataaggcttagtccgtaaacaaactttggcactgtattcggtgcttttttt

SEQ ID NO: 129-133 - skipped (5 entries)

SEQ ID NO: 134 - DNA, 5208 bp, synthetic construct
  misc_feature 1..5208: note = source = /note="Description of Artificial Sequence: Syntheticpolynucleotide"
  source 1..5208: mol_type = other DNA
atgaccaagaacatcctgggcctggacctgggcaccaacagcatcggctgggccctgatcaagatcgaccacgagaacaagaccctgaagatcatcgccctgggcagcaggatcatccccatggacggccaggagttcagcaagttcaacgccggccagaagatcgagagcgccgccggcaacaggaccgccctgcacagggccaggatcaccaaggagaggtacctgctgaggagggacaggctgcacctggtgctgaacctgctggaggccctgcccaaccactacaagatcgaggtggacttcgagaggaacgacaagaggtgcggccagttcaaggagggcaaggagcccaagatggcctacctgcccaccaagaacctggagaacaagttcgacttctacttcgaggaggccttcaacgagatgatcgaggacctgcagaaggtgaaccccgagatcaagaacgagaagaagaagagggtgcccaaggactggaccatctacttcctgaggaacaaggccatgagccagaaggtgagcctggaggagctggcctgggtgctgctgagctacaaccagaagaggggcaccgacagcgaggagatcgagaacgaggacgagaagagcgagatcaaggagcagatcgacctgaaggtgatcaaggccgagaagaaggtggacgtgaacggcgccttcttcgagatcaccctgaacgacgccgagaacttcaagtacaaggagtacaccaccaagcagctgaccttcgaggacgacgtgaaggaggtgaccaagatcctgaagctggacgaggccggcaacatcatcaacgagaagaccgcctaccagatcagcgacctgtacaacctgaccctggccaacatcgagcacaccgacatcaacgacaagaaggccaagcacaagtacgacttcatctacaccaacggctggtgcaccgagaagaagaaggagaacttcgacgtgacctaccagaagctggagaagcagatcaaggaggagagcaaggtgatcaccgagctgttcgtggtgagcaacaagtacgacttcgccggcaagcccgagagcatcatccccagcatcaagctgcccgacttcaacagcgagggcagcaaggactggaccctgctgaagaagaagaccgagaaggagatcgtgaagagcgagaagaccctgagcggctggatctacgacgtgctgaagaacgacgtgaacaccggcgagaggaccaagatcatcggcggcctgttccagaccatcgacaggaagttctacagggaggagctgtaccagatcatcaacacccagaggaagttccacaccagcaccctggacgacaaggacaccttcgagaagtgcgtgaagctgctgtacccccacaacaaggaccacagcaagaccctgctggagaacaagcaggccctgaccaacctgctgatcgaggacatcctgctgtaccagaggcccctgaagagcaagaagagcgagatcagcgactgcaagtacgagatcgactactggaaggaggacgtgaacatcagcaccggcgaggtggtggagatccccgtgtacaagaaggccatcttcgccagccaccccctgttccaggagttcaggatctgggacaagatccacaacatcaagctgatccagctggagagcaaggacgccgacggcaacacccagaccaacgtggacatcaccagccagtacttcaagcccgagaactacagggccctgttcaaccacttcaacggcaggagcaccgtggccatcgacgacttcctgaagttctgcgaggagcagttcaagctgggcatcggcaagaagggcgagaggaagatcctgtggaactaccccgtggaggaggagttcaagggcaacgagaccaggaagggcttcgagaacaggttcaggaagtgcggcttcgacggcttcgacgacttcatgacccagcagaaggagatcgagctgtggcactacctgtacagcgtgagcagcgccgagaggaagaaggtgagccaggtgaaggacagcagcgaccccaagttcggcaagaccggcatctggaacttcttcaccaagtacttcaaggacgagaacatcagcctggagaccctggagaagctgtgcagggacttcgagacctaccccaagttcaccagcaagtacgccagctacagcgtgaaggccctgaacaagatgctggccgtgatgagggtgggcaagaacttcctgaccgccgagagcgtgaacgagaagtggcaggagaagtacatcgagagggccgacaccatcatcaagaagaacaacgagatcgactggagcgccgagagcatcgacctgaccgacatcatcctgaacgacgtgaacgtgaagaacggcgagatccccttccccaagggcctgttcaacaccttcaagagcttcgagaccgtggacgacttcgagttcctgaacctgacccaggccagctacttcatctacggcaggcacagcgagctggcccaggccaagtactggaacagccccaccaagatcagggaggagatcaccaaggagctgaagcaccacagcctgaacaaccccaccgccgagaaggtgctgaaggagaccctgaaggtggtggccgacatctgggagatctacggcaacagcgaggagaagttcttcaacgagatccacctggaggtggccagggagctgcagaagagcaaccaggagaagaaggacatcatcgagaggcagaagaacaacagggccgagaacaacaggatcaggaacatcctggaggagttcctgagcagcagcccctacaacgccaagaggggcaaccaggaccacttcgagaggctgaagatcgtggaggacggcgccaaggtgaggagctacagcgacaaggagttctacagcaacaacaaggacaagttcagcaagatcgacatcgaggtgatcctgaagaagaagaagatcacccagagcgacttcgagaagtacaagctgtggatcgagcagggctacaagagcccctacaccgaccagatcatcaagctgaccgacctgttcgacggcaacaagtacaacgtggaccacatcttcagcagggccgccatcaccaacgacagcctgaacaacaaggtggtgtgcgaggccgtgatcaacaggttcaagagctacaagaccggcagggagttcatcgcccagttcggcggcaagacccacaccatcttcgacgacaagctgaacaagaacgtgaccttcagcctgatcgacgaggacgcctacgtgagcctggtgaagagccagttcaaggacgccaagaggctgatcctgctgagcaaggaggtgcccaaggccttcaccgagagccagctgaacaacgccaagtacatcgccaggaaggccatggagctgctgagccacatcgtgagggaggagggcgaggtggagttcaggagcaagaacgtgctgcccgtgagcggcgccatcaccgacaggctgaagaaggagtggaagatcaaccagatctggaccgagctgctgaagcccaggttcgagaggctgaacaagatccacaacagcgaggccttcggcagctacgccatcagcaagagcggccaccagtacttcgacatcaacaccaagtacatcctgggcgagaacgacaagttcgacctgaagaggctggaccacaggcaccacgccctggacgccctgatcatcgccctgtgcaccgacaaccacgtgcagtacttcaacaacatcaacagcggcatcaccaacaagaagaagggcaagatggaggccatcaagaagcagagggccggcatcaagaggcagatcatgtacagcgagaaggacaaggagaaccccaacgagaaggtgtggaggtacatgctgcccggcagcttcaggaacaaggagagcgtgaacaacgagaaggacagcgtggtggacctgagctgggagaacaactacagcgccaaggagagcaacgactacaggaagaccatcctggagtgcctggacaactgcatcgtgagcttcaagaacgacttcaagatcgtgagcaagagcagcaacaagtacgagagctactacgacgagaacggcaacctgaggctggacagcaacggcaagccccagaaggagttcatcagccagcagaacaacaaccagaagcactggagcgtgaggaagcccctgcacaccgacaaccccagcgccgagatcaccctgcagttcgacaggctgaagctgatcgacaacctgggcaaggtggacctgatcatcgaggagaagatcaaggacgccgtgaaggagatcctgggcatgcacaacaacaagatcggcaaggccgagagctacctgaagaagaaccccctgatcctggaggagaagaagatcgagtacaccgacttcaagatcagcaacaagaagtacaggaagaggcagcccatcaccaacctgagcgtgaggaccggcaccggcgccctgcccacctacgacagcgtggtggacaggatcaacaaggtgagcgacttcgtgctgaggaacgagctgctgcagcacctgaagatcaacgacaacgacatcgacaaggccttcagcatcgagggcatcaacgagttcaacagcaacaggaagatccccgtgttcaggctgcccatcagcgagagcgccaccctgaagttcaagatcggccacaagaacagcaacagccacaagtgggtggagaccggcggcaacttccacttcaggatcgccgacgaggagaacagcagggactacgagaccatccccctgaggatcgccatcgagatggagaaggacaacatcatcaggaggcagatcgtggacaacgagaacgagatcgtgctgagccccaacgacctggtgtacgtgcccctggagaagaacgagatcgtggacttcaacaacctgaccatccagcagatcaagaggatctacaagttcgtgttcagcaccaagaaggaggcccacttcatcccctacagcagcagcgccgagatcatcaagaacgagaacggcaccaacggctacagcgagaggaccaaggacttcttcgacggcaacgtgctgcaggacgacaagggcaagcccatccaggtgaagagcgtgtgctggaagctgaaggtggacaggctgggcaacatcagcaaggcctga

SEQ ID NO: 135 - DNA, 3675 bp, synthetic construct
  misc_feature 1..3675: note = source = /note="Description of Artificial Sequence: Syntheticpolynucleotide"
  source 1..3675: mol_type = other DNA
atgaagaagctgatcgtgggcctggacctgggcgtgaacagcatcggctgggccgtggtgggcgacgacgacagcaacaggcagatcctgggcatgggcagcaggatcatccccctgagccccgacgacaacaacgagttcgtgaccggcaacgccatcagcaagaacgccaagaggaccgagaagaggacccagaggaagggctacgacaggtaccagcagaggaggaggaagctggtggccttcctggagaggcacagcatgatggtggagaaggagctgatgtgcctgccccccctggagctgtgggccctgaggaacaagggcatcacccaggccctgagcagcagggagctgggcagggtgctgtaccacctgaaccagaggaggggctacaggagcagcaggagcgaggagagcagcgacggcaagaagaacaccgcctacgtggaggaggtgaagggcaggtacgaggagctgaagaccaggggcatcaccatcggccagcacttctaccagaagctgcagaccgcccacaacaggaacgagccctacaggatcaagcagcaggtgttccccaggcaggcctacatcgacgagttcgacgccatcatcaaccagcagaagaaccaccacagcagcctgaccgccgacgagatcgccttcctgagggacgagatcatctacatgcagaggcccctgaagagccagaagggcctggtgagcatctgcgagttcgagggccagtacaggaagaacgccaaggacgccgaggtgttcgtgggccccaaggtggcccccaggagcagccccctggcccaggtgtgcaagatctgggagagcatcaacaacatcaccttcaccaacaagaggagggagccctaccccatcaacaccgaccagaagctgaggctgttcgacgccctgaacaagaccgagaggctgagccagaaggccatcttcttcatcctgggcatcaagcccggcgacggctacaccggcaacaagcagaccgccaagggcatccagggcaacctgaccaacgccgccatcagcaccatcatccccgagaggaaggacctgctgaacttcgagctgaagatcgtggtggacgaggaggacgcccacctgatcaacaggagcaacggcgagatcatcagcaccgtgcagaagaagaccgtgagcgccgactacgagaggagccccttcttcaggctgtggcacgtgatctacagcatcagcgacatcgacaagtgcatcgagaccctgatggagaagttcggcctgaccaaggagcaggccgtggccctgagcaggctggacttcaggaaggccggcttcgccaacaagagcgccagggccatgaggaagatcctgccctacctgatggacggccacatcttcagcgacgccatgagcctggccggctacaaccacagcgccagcctgacccacgaggagaacctgaagaggcagctgaagggcagcctgcccctgctgaagaagaacagcctgaggcagcccgtggtggagaagatcctgaaccagatgatcggcgtgatgaacgccatcatcaaggagtggggcaggcccgacgagatcagggtggagctggccagggagctgaagcagagcgccgaggagaggaacaaggccttcgccgccctgagcaagagggagagggagggcgagatcatcaccaagaggatcgaggccgagttcaggcagttcggcatcagggccaccaggaacaacatcctgaagtggaggctgttccacgagatcagcaacgacgaggccaggctgaacgccacctgcgtgtactgcggccaccccttcggcatcaccgacgccctgaggggcagcagcgtggacatcgagcacatcatccccaagagcaagctgttcgacgacagccagggcaacaagaccctggtgcacaggaggtgcaacgaggacaagggcgacaggaccgccttcgacttcatgagcgccaagggcgagagcgtgctggccagctacatcgagaccgtggacaggctgtaccagagcaacgtgatcagcaggcacaagagggacaggctgctgaccaccggcgacgacatccccaaggacttcatcgagaggcagctgagggagacccagtacatcgccaggaaggccaaggagatcctggagcagatctgctacaacgtgtggagcaccagcggccagatcaccgagtacctgaggaggatctggggctggaacgacgtgctgatgaacctgcagctgcccgtgtacagggacctgggcctgaccgagtggaaggagtacaccgacagggacggcaacctgcacaggcaggaggtgatcaaggactggagcaagaggaacgaccacaggcaccacgccatcgacgccctgaccatcgcctgcaccaggcagggcttcatccagaggatcaacaggctgaacgccaccaacaacagggaggagatgagggccagcctgaacggcaactacgaccccaagaagaacctgctggagaactacatcttcgccctgaagcccttcagcaccaagcaggtggaggtggccgccgcccagatcctgatcagcttcaagcccggcaagagggtggccaccctgagcaagctgaaggccaagggcaagaacagcggcaccggcgtgatcgtgcccaggggccccctgagcgaggagagcgtgtacggcagggtgaggctgatggacagcaagaagcagcccgtgaggtacctgttcgagcaccccgagctgatcttcaagccctacatcagggtgctggtggaggagaggctggccagctacagccaggacctgaagaaggccctggccagcctgaagaaggaccccatctacctggacggcaccaagaccatcatcctggagtggggcagctgctacaaggacgaggtggtgatcaagtaccccctgaccgacatcaaggccaaggacacccagttcatcatcgacggccacatcagggccatcgtgaacgagaggctgagccagtacaagggcaacgagaagaaggccttcgagcaccccctgtacagcgacgccgcctgcaccaaggagatcaggagcgtgaggtgcctgaccggcctgaccgccgtggtgagcgtgaagaaggacgagagcggcagggagatcggcttcgtgaagcccggcaacaaccaccacatcgccctgtacaccgacgccgagggccagaagagggagcacctgtgcaccttctggcacgccgtggagaggaagaagtggggcatgcccgccgtgatcacccagcccggcgtgatctgggacaacatcctgcagaagcaggacaacttcccccaggccttcctggagaagctgcccctggaggcctggaccttcgacaagagcctgcagcagaacgagatgttcatcgtgggcctgaccatcgaggaggtgcagacctgcatcgacagcttcgactacgccaggctgagcaagcacctgtacaggatccagaagctgagcagcaccggctacaagatcgtgctgaggcaccacctggccaccaccatcgagcacaccagggacatgatcggcatcgccagccccagcagcttcaccggcatcaaggtgtacgtgagcaagaccggcaagatcagcatgccccacgactga

SEQ ID NO: 136 - DNA, 4374 bp, synthetic construct
  misc_feature 1..4374: note = source = /note="Description of Artificial Sequence: Syntheticpolynucleotide"
  source 1..4374: mol_type = other DNA
atgaagaacatcctgggcctggacctgggcaccaacagcatcggctgggccctgatccagagcgacttcgacaacaaggagggcaagatcctgggcaccggcagcaggatcatccccatgagccaggacatcaaggacgagtacggcaagggcaacagcatcagccagaccgccgacaggaccaggttcaggagcctgaggaggctgagggagaggcacctgctgaggagggagaggctgcacaggatcctgaacatcctgggcttcctgcccgagcactacgccgaccagatcgacttcaagaacaggctgggccagtacctgcccgagaaggagcccaagctggcctacaggaacaacgagttcatcttcaaggccagcttcgaggagatgctgatcgacttcagggagcagcagcccgagatgctgcagggcgacaagaaggtgccctacgactggaccatctactacctgaggaagaaggccctgacccagaaggtggagaaggccgagctggcctggctgatcctgaacttcaaccagaagaggggctactaccagctgaggggcgaggagcagcaggagaaccccaacaagaaggtggagttccacagcctgaaggtggtggacgtgatcgccgacgagacccagaggggcaaggccgagacctggtacagcctgatcctggagaacggctgggtgtacaggaggagcagcaagacccccctggacaactggagggacaagcagagggacttcatcgtgaccaccgacctgaacgacgacggcagcatcaagaaggacaaggacggcaacatcaagaggagcttcagggcccccgacgagaacgactggaccctgctgaagaagaagaccgagcaggacatcgaccacgccaacaagaccgccggcgcctacatctacgaccacctgctggtggcccccgaccagaagatcaagggcaagctggtgaggaccatcgagaggaggttctacaagaccgagctgaaggccatcctggccaagcagcagaacttccacgccgagctgcagaacaaggacctgttcctggactgcgtgagggagctgtacaggcacaacctgagccacctgagcaacctgaaccagaaggacaccatccacctgctgaccgaggacatcatcttctaccagaggcccctgaggagccagaagagcagcatcggcaactgccccctggagttcaggaggtaccagaacaaggagggcggcgaccagaccgagtacctgaaggtgatccccaagagccaccccctgtaccaggagttcaggctgtggcagtggatctacaacctgggcatctaccagaaggaggacgacaccaacgtgaccgccgacctgatcaagggcatccagggctaccaggacctgttcgacttcctgaacagcaagaaggagatcaagcaggacaccctgatcaagttcctgctgagccagaccggcctgaagggcaaggagctgaacaaggccgccctgaccctgaggtggaacttcgtggaggacaagacctacccctgcaacgagaccggcaccgagatcagggccaggctggccaaggtggcctacatccccgagaacttcctgaccgccgagaaggccctgagcctgtggcacatcatctacagcgtgaacgacaagaaggagtacgagctggccctgaggaagttcgccaagaagcaccagatcgacgaggagaccttcttcatcaacttccagaagttcccccccttccagagcgagtacggcgccttcagcgagaaggccatcaagaagctgctgcccctgatcaggctgggcaagtactggcactgggaggccatcgaccccaagagccaggagaggatcgagaagatcctgagcggcgaggccgaccagaacatcaaggagaggatcagggagaaggccatgcacctgaccagggaggagcacttccagggcctgcagctgtggctggccaactacatcgtgtacgacaggcacgccgaggccgccaaccccgacaagtggagcaccgtgagcgacctggaggactacctgaaggagctgaagcagcacagcctgaggaaccccatcgtggagcaggtggtgaccgagaccctgagggtggtgaaggacatctggctgacctacggcaacggcgccaagaacttcttcgacgagatccacatcgagctggccagggagatgaagaacaccatggaggagaggaagaggctgaccagcatcgtgaccgacaacgagaacaccaacctgaggatcaaggccctgctggtggagctgttcgaggacggcaacatcgagaacgtgaggccctacagccccatccagcacgaggccctgaagatcttcgaggacggcatcctgaacagcggcatcgagatcgacgacgacatcctgaagatcagcaagaccccccagcccaccagcaccgagctgaagaggtacaagctgtggctggagcagaagtacaggagcccctacaccggcaacgtgatccccctgaacaggctgttcaccaccgactacgagatcgagcacatcatcccccagagcaggttcttcgacgacagcttcagcaacaagatcatctgcgagagcgccatcaacaagctgaaggacaagcagctgggcctggagttcatcaagaaccacgccggcaccatcgtggagctgggcctgggcaagaccgccagggtgttcgacgaggagaggtaccaggacttcgtgaaggccaactacaccaagaaccccggcaagaggagcaagctgatgctggaggagatccccgacaagatgatcgccaggcagctgaacgacaccaggtacatcagcaagttcatcaccagcgtgctgagcaacatcgtgaggagcgagaccaaggacgacggcgtgaacagcaagaacgtgctgctgtgcaacggcaggatcaccagcgtgctgaggcaggactggggcatgaacgacatctggaacgagctgatcctgcccaggttcgagaggctgaaccagatcaccgacagcaccgtgttcaccgcctggaacgagaaccaccagaagttcctgcccaccgtgcccatgggcttcagcaagggcttccagaggaagaggatcgaccacaggcaccacgccatggacgccctgatcatcgccagctgcaccagggaccacatcaacctgctgaacaacgagtacgccaagagcagcaagaggttcgacctgaacaggaagctgaggaagttcgagaaggtggcctacaagagccccgtgaacggccagcagatcgacaaggacatccccaccgtgttcatcaagccctggcagaggttcaccatcgacgccaagtgcagcctggaggacatcatcgtgagcttcaagcagaacctgagggtgatcaacaagaccaccaactacttcgacggctacaaggacgagcacggcatcgtgaacttcgacaacaagggcgcccccgtgaagcagcagaggaagcagaccaagggcgacagctgggccatcaggaagcccatgcacaaggacttcgtgtacggcaaggtggacctgaagcacatcaagatccccaagggcaagttcgccaccgccatcaggaagagcctggacaccaccttcgaccagaagaagatccagaccatcaccgacaccggcgtgcagaagatcctgatcaactacctgcagagcaaggacaacaaggccgagctggccttcagccccgagggcatcgaggacatgaaccagaacatcagggcctacaacgacggcaagctgcaccagcccatcaagaaggtgagggtgttcgagatcggcagcaggttccccctgggcgagaccggcaacaagaagaccaagtacgtggagaccgccaagggcaccaacctgttcttcgccatctaccagcacaagaacaagaggaactacgagaccgtgcccctgaacaccgtgatcgagaggcagaagcagcacctgagccccgtgcccaccgaggacgacaagggcggcaccctgctgttctacctgagccccaacgacctggtgtacgtgcccacccccgacgagctgggcaacaacctgggcggcctggacatcaggaacctgaacaaggagcagaggaggaggatctacaaggtggagaaggccagcggcgtggagtgctacttcatcaggcaggacatcgcctacctgatcaagagctacgacgccaccaccaagatcggcgagctggagagccagaacaagctgcagaccaccatgagcagcgacaggctgaagatcgccgacgtgtgcatcaagctgaagatcgacaggctgggcatcagcaggtga

SEQ ID NO: 137 - DNA, 4989 bp, synthetic construct
  misc_feature 1..4989: note = source = /note="Description of Artificial Sequence: Syntheticpolynucleotide"
  source 1..4989: mol_type = other DNA
atgaagaagatcctgggcctggacatcggcaccaccagcatcggctacagcatcatcaaggtgagcgacgagaagaacgagaacatcatcagcgacaaggtggccgccagcgacatcaacaacgacaggatcggcatcttcgaggaggccatcggcgtgaggatcatcaaccaggacaccgacaggttcgacaggggcctgaagctgaacgaccccaagggcagcaccctgacccccaccgccaacaggaggaagttcaggggcgtgaggaggatgaggaacaggtacaagctgaggaggaacaagctgtacaaggtgctgagcatcctgggcctgacccccgacgagagctacttcaccaacaagaagggcaagaggggcaaggacaacgacatcggcaaggccctgtacggcctgagggagagggccgccagggagaagatcagcctgagcgagctggccagggtgctgctgcacctgaaccagctgaggggctacagcagcgacaggttcgccaacgacgaggagaccaagttcgactactacctgaccgaggtggtggaggccgactgggagaacaggaccgccgtgttcgagaagggcagcaccgaggacgtgaagtactaccagttcaaggccaagctgaggttcgtggagccctacgtgatcgtggaggacgacgagaagaccatcctgtacgaggtggagggctacatcttcaagaaggagctggacttcgaggtgggcgacttcatcaccatcaaggcccccgagttcaagcagaacaagaagggcaaggtggtgatcgaggagtactacaagatcacccccaccaagcccgacgccaccgactggaagtacaagtaccagaccctgcacaagaacctgagcgactggtgcaaggccggcggcaccgtgggcagctacttctacaagaacttctacgagctgaccaccctgagcaggatcaggaacaacgtggtgaacagggagtggtacgagaacgagttcgacgccatctggaccctgcagtacgagttctacaaggacttcttcgagaagatcgacgtgagcgagctggtgaagggcgtgttcaaggactacagcgccgtgctgaacgacgtgatcagcaagagcggcaacaaggcccagctgcagaccctgatcaaggacaagatcatcttctaccagaggccctggcagcaggccaagagcaagggcaggtgcgagttcgagaagatcaaggtgaagaggaagttcgccatcaagggcaccggcaccaaggagctgagggaggagcacatcggcaggaaggtggtgcccaggagccaccccatcttccaggacttcaaggtgtggcagcagatcaacaacgtgaggctgatctggaacaccgccgacgagaagatcaacctgttcgagaacgccgagctgagcgagaagctgaccggcaagaccatcgagaaggtgaaggagctgctgttcaagaagctgcagggcagcaagaccctgagctggaggaccttcgtgaaggaggagctgggcctggacacctacgacgagatcgaggagaagaggaagagcaaggtgagcaagaagcagggcctggacatcgagaccggcgagatcgtggacagcttcttcagcgtgaacttcaggaagaggaagagggacggcaccttcgacgacatcaagctgaagggcaacaccaccaaggccgagctgcagaacatcctgaaggagaagagggccgagtggttcgacaccctgcacaaccagaacaagaaggtgaccaacctgcagctgctgtgggagatcatctacgacatcaccaacagcgacgccaccaaggtgagcagcatcatcaagaagcacttcgacttcgacgagagcgtgtgcctgaccctggccaaggtgcagttcgacgacgccggcatggccaacctgagcgccaaggccatcaggaacctgctgcccctgatgagcgacggcgccaactacagcaagatcaccaaggccaaggtggacgagctgatcagcctgaacaccagcgagaccgacgtggacgccgacgacaagctgaacggcctgaaggacttcgtgaccgacaggaaggccaggatcaggctgagcaagttcagcaacgagaacgacttcaagtacctgaactactgggaggccgccgccatcgtgtacggcagccacagcagcaagaagagcagcgagaccaagatcatggagagggtgaagaaccacagcatgaacaaccccgtggtggagaagatcgtgaacgaggccatcagcatcgtgaacctgctgaaggagaagtacggcttcgacgagatcaggatcgagctgagcagggagctgagggccagcgccgacgagaggcagcagatgtgggagggcatgagcaacggcgccgccaagaacgagtgggccaagaagatgctgagggagatcaagcaggccatgctggacaacaacagggacatcagctacctggacaccgagatcagcaacagcaacctggacaagatcaagatcatcgaggacgtggtgaagtaccagaagcccgtggagttcaagaccaaggagaaggagtacaagctgaccgagcccaccaaggccgaggtgaccaagtacctgctgtggctggagcagaacttcaagtgcccctacaccaaccagcccatccccctgaccgacgtgttcgccaggggcaaggtggtggagatcgagcacatcatccccagggagaggtactacagcaacgcctacgccaacaaggtgatcacctggagggaggtgaaccaggagaagggcaacaagaccgcctacgagttcatcgtgagcaagaggaaccccgccggcaccgtgcaggtgggcaagaaggagatcagcctggtgagcgccagccagtgggagaaccacgtgaaggagatgttccccaagagcggcaagaggaccaacctgctgaggaaggagatccccgaggaccccatcgagaggaccctgaaggagaaccagtacatcaacaagaagctgaaggagaagctgggcgagctggtgggcagcgacaaggtgtgggtgaccagcggcgccatcaccgacatgctgagggagaagtggaagctgaacgacatctggaaggagctggtgcaggagaggttcctgaagttcaacaacggcgaggtgaaggacaggctgaacctgaagtacaccaccaagtactacaacaacaagaccaaccagtacgaggacgtggagaagttcgccggcatgagcaagaggatcgaccacaggcaccacgccctggacgccatcatcatcgcctgcaccaagcagagccacatccagtacatcaacaacctgaacgccatcaacagcgccgacatcgagaacgacgacaacaagaagaccaagtacaagggcatcaagaccgacgtgtgcatcggcaacagcagcagcaagttcaagttcccctgggacgagaacaagttcatccccgaggtgaagcaggccctgcagaacatcctgatcagccacaagaacagcaacgtgctgatcagccccagcaagcacaggaacaacaaggacatcaacagcggcaaggtggccagcgtgaggggcgagctgcacctgcagaccaactacgccaagaagaagtacttcgagaacgagaagatcgacatcgtgaagctgatccccctgctgttcaagaagaagttcgagaaccagaaccagaccctggtgaggttcaagagcttcgacgagatcatcaaggaggccgtgctgaaggagaagtaccagaacgtgctgatcagcctgttcaaggactacgacagcgagaagctgagcacccagaccaccaaggacttcagcaagaagatcctgaagaggatcgaggacgagaagctgttcatccacgagaagagcggcgagaagatgacctggctgagcaccttcaccgagaagaacgccagcgtgaggcccatgggcctggccatggacctgaacagcgagaaggagatcaaggacatcagcaaccccaggctgaggaggatcggccagtacaggctgaactacatcaacaagaagatcatcgagatcaaggccctgaagctgcccttcaaggaggaggagaacaacaggatcagggaggtgagggagatccccctgtacaacaacgccatctacgagctgaggatcaagcagaaggacggcaagtaccactgggtggagatcaaggacgtgcagcacagcgacctggagaacatcgagtacgccaagcaggagaccaccatcgccgtgaagaacaagatcaaggacttcagcctggacgagctgaaggagaggtacatcagcaaccccatcttcctgagcgagaagcccacccccgtgaagaaggccaggcagaagagcttcttccaggacctgtaccagctgaacgacggcaggtacgtgtacagcagggacgtgttcatgacctacgtgttcgtgcccgaggacagcaacaggaaggacgccaagagggagctggagttcctgaagttcttcgacgccgtgaagatcgtgaccctggagaagcccgagaagatcgactaccagaagctgatcaagaaggaggaccacaagctgctgttcaccctgagcaagaacgacatcgtgtacatccccgaggagatcctgaccgacgagcagatcgccgagatcaactggaacgacaagagggacatcgtgcccaagctgttcgtggtgaaggagatgacccccagcaggaacgagatcgtgttccagcacctgtacaagagcgacagcatcagggtgaacggcgacgaggccaagaacatcctgaacaccgagaagctggaggagcagatcaagtacggcgacaccaacatgtggaagaggtgcatcaaggtggacatcgacaagctgggcaccgagatcaagccctactgggagaacaacaagatcgtgctgtga

SEQ ID NO: 138 - DNA, 3228 bp, synthetic construct
  misc_feature 1..3228: note = source = /note="Description of Artificial Sequence: Syntheticpolynucleotide"
  source 1..3228: mol_type = other DNA
atggactacaggatcggcctggacatcggcaccaacagcgtgggctggggcgtgatcaggatgcagtacaacgacctgctggagaggtacgagaagcagggcatcgtggacgccggcgtgaggatgttcgacaaggccgagatccccaagaccggcgccagcctggccgcccccaggagggaggccaggagcagcaggaagaggctgaggaggaggagccagaggaagaaggccatcaggtacctgatcatcctgcacgagctgctgagcgaggaccagctgcagcagctgtaccccctgcagaaggagagcatcgacatctgggacatcaggctggagagcctggacagggtgctgaaccagaccgagtgggccaggctgctgatccacctgggccagaggaggggcttcaagagcaacaggaagagcgagtacaaggaggaggagaccggcaaggtgctggtgaacatccaggagaaccagaaggccctgcagcagtacaggaccgtggccgagatgtggatgaaggacgccaagttcagccagttcgacaagaagaggaacgcccccggcgagtacctgttcagcgtgagcaggtacgacctgcagaacgagatccagaccatcttcgagagccagaggaacctgggcagcccctacgccaccaccgacctggaggaggagtacatcagcgtgtggagcaagcagctgcccttcgccagcggcgaggacatcctgaagaaggtgggctactgcagcctggagaggaaggagaggaggatccccaaggccacctacaccttccagtacttcatcctgctggacggcctgaacaagatcagggtgggcgccgacgccaggcagctgaccaccgaggagaggagcatcctgatcgagaagatcctgaccaggaacgactacttcagcaagaagagcctgcccgacctgacctacggcgacctgaggaagtggctggccctggacagcagcctgctgttcaaggacctgacctacgaccccaacgagaaggtgagcaaggtggagaagaaggtgttcgccaacctgaagagcctgtacgagctgaggaaggtggtggagaccagcagcaacggccagagcttcgagaggatcgactacgacaccttcggctacgccctgaccgtgtacaagaccgacgaggacatcaggaggtacctgaagaagcccagcaacctggcccacaaggtgtacgaggaggacctgatcgagaggctgctgagcctgagctacgagaagttcggccacctgagcctgaaggccatccagaccatcctgccctacatggaggacggcatgatgtacaccgaggccgtgcaggccgccggctacgacatcaccggcctgcagagcgccaagaggaccctgctgctgcccaccatccccgccgacatcaccaaccccgtggtgaggagggccctgacccagaccaggaaggtggtgaacgccatcatcaagaggtacggcagccccctgaccatccacatcgagctggccagggagctgagcaaggaccaccaggagaggcagcagatcctgaagaaccagcaggccaactacgagaggaacaagggcgccatcagcgtgctggtggagaacggcatcctgaaccccaccggctacgacatcgtgaggtacaagctgtggaaggagcagggcgagaggtgcgcctacagcctgaaggtgatcccccccagcgtgttcttcggcgagctgaagagggagaggaaccacatccccaccctggaggtggaccacatcctgccctacagccagagcttcatggacaactaccacaacaaggtgctggtgtacagcgacgagaaccagaagaagggcaacaggatccccagccagtacctgatggccgtgagccccgagaagtggaccaagttcgaggagtacgtgagcagcaacaagggcttcagcaagcagaagaggcagtacctgctgaagaaggactacagcagcagggagagggacatcgtgaaggagaggcacctggtggacaccaggtacgccaccaggttcatgaagaacttcatcgagaagaccctgctgttcaaggagagcaggagcagcagcctgaccaagagggtgcagaccgtgaacggcaagatcaccgcccacttcaggaagaggtggggcctggagaaggagaggaccgagacctacctgcaccacgccctggacgccatcgtggtggcctgcaccgaccagcacatggtgaccagggtgaccgagtactaccaggagagggagaggaacgtgaggcagccctacttcccctggccctgggagggcttcagggacgagctgctgaactacctgaacaggcagcccgacagcctggagatcagccagagcatcaagcagaacctgttcctgagggactacctgatggtgagcaggatgcccaagcacagcgtgaccggcatgagccacaagcagaccatcaggagcaaggcctgcgtggacgagaagggcaaggtgaagaccaccaagagggtgctgctgcaggacatcaagttcgacagcaacggcgacttcaagatgatcggcaaggagcaggacatggccacctacaacgccatcaaggagaggttcctgagcagcggcggcaacgtgaagagcgccttcaccgagcccctgcacaagcccagcaagaagggcaagggcaacgtgatcaggaaggtgaccgtggaggaccagaccaagagcttcgtgagggacgtgaacggcggcgtggccgagaacggcagcctggtgaggatcgacctgttcgagaaggagggcatgtactacgtggtgcccatctacgtgggcgacaccgtgctgaagcagctgcccatcaagatcagcgccagcaacaggggctactacaagtgggtggagctggacgagaactacaggttcaagttcagcctgtacgcccacgacctgatcaggatcgtgaccaaggacgaggacaggttcttctacttcagctacttcgacaacgacggcaacaggatcaagttcctgaacatcaacagccccaccggcaagaacgagaacaggtacggcgtgaggagcatcaagctgatcgagaagtacaacgtgagcaccctgggcgacatcagcctggtgaagagcgaggagaggcagctgttccagggcatgaagaagaaggtgctgaacatcatcaactga

SEQ ID NO: 139 - DNA, 3207 bp, synthetic construct
  misc_feature 1..3207: note = source = /note="Description of Artificial Sequence: Syntheticpolynucleotide"
  source 1..3207: mol_type = other DNA
atgaagtacgtgctgggcctggacatcggcatcgccagctgcggctgggccgtgatcaaccaggagaagcacaggatcgaggacctgggcgtgaggatcttcgacaaggccgagaaccccaaggacggcaagagcctggccacccccaggagggacgccaggagcaccaggaggaccctgaggaggaagaagcacaggatgcagaggatcaagatcctgctggtgaagcacggcctgctgagcaagaccgagatcgaccacctgtacgagagcgccaccgagatcgacgtgtggtacctgaggctgaacgccctggagaggaggctgaaccccaaggagttcgccagggtgctgatccacctggccaagaggaggggcttcaagagcaacaggaaggagaccaccctgagcgagaacggccagatcctggagaacatcagcgagaacctgcagatcatggagcagcagaactacaggaccgtgggcgagatgatcctgaaggacaagaagttcgagaaccacaagaggaacaaggacggcacctacatcggcaccgtgaccaggcagcagctgaaggaggagatccagatgatcttcaacgcccagaggctgtacaagaacgactacgccaccgaggagttcgagagcagctacctggagatctgggccagccagaggccctacgccagcaaggaccagatcgagaagatgatcggctactgcaccctggagcccaaggagaagagggtgcccaaggccagctggagcttccagtacttcgtggccctgcagaccatcaacaacctgaggctgatcaacaaggacaggatcgaggagctgagcttcgaggagaagaaccagatcatgaacctggccctggagaagagcatcgtgaagtacatcgacatcaggaagctgctgagcatccccaacgagttccacttcaacaacctgctgtacagcgccgacaccgtggacaccgccgtggagaacaagaagtgcatcgagttcaaggagtaccacagcatcaacaagctgtacaagcagatctacggcaagagcgtgcccaacctgctgcccatcgactacgacaccatcgcctgcggcctgaccatcttcaaggacgacaaggacatcctggcctacctgcagaacaagtacgtgaacgccaagggcaagcccatcagcaacctggccaagaagacctacgacgacaccttcatccaggccctgctgaccctgaacttcagcaagatgggccacctgagcttcaaggccctgaagaacatcatccccttcctggaggagggcctgagctacgacaaggcctgcgagaaggccggctacaacttcaagggcaccagccacgccgagaagaccaagtacctgcccgtgatcccccagaacaccaaccccgtggtgcacagggccctgagccagaccaggaaggtgatcaacgccatcatcaagaagtacggcagccccagcgccatccacatcgagaccgccagggagctgagcaagaccttccaggagaggaaggagatcgacagcatgtaccaggacaacagcaagaagaacgagcacgccatccacaagctgaaggagctgggcctgatcaaccccagcggcatcaacatcgtgaagttcaagctgtggaacgagcaggacggcaggtgcatgtacagcggcaagtacatcgagccccacaggctgttcgaggagggctacaccgaggtggaccacatcctgccctacagcaggagcctggacgacagctacaacaacaaggccctgaccctgggcatcgagaaccagaggaagggcaacaagaccccctacgagtacatcggcaagaccagcatctggcacgagttcgagaccagggtgcagagcaacaagaggatcaacaagaagaagcagcagaagctgctgctgcagtacttcagctacaccagggagcaggagttcatcaagaggaacctgaacgacaccaggtacgccaccatctacctgagcaccctgatccagcagcacctgatcttcagcgagagcagcaggaagaagaaggtgcacaccgtgagcggcatcatcaccagccacctgaggagcaggtggggcttcaacaaggacaggaaggagggccacatccaccacgccctggacgccgtgatcgtggccgtgaccagcgaccacatgatccagagggtgaccaagtactacaagctgaaggagctgaacaggaacctgcaggccaagaggatgcagttccccgagccctgggagggcttcaggctggagctggaggccaggatcagccccaacacccagcagtacctgaagaggatcctgttcaagaactacgccgacgtgaacctgagcgagatcaagcccatcttcgtgagcaggatgcccaagaggagcatcaccggcgagctgcaccaggagaccatcaggaagctgatcggctacaacgagaagggcaaggtgctgaccgccatcaagaccaagctggaggacatccccttcgacgccaacggcgacttccccatgtacggcaaggagaccgacctgtacacctacaacgccatcaaggagaggtacctgagccacaagaaggacaagaggaagagcttccaggaccccctgtacaagcccaccaagagcggcgagatcggccccctgatcaagagcatcaagatcatggacaccaggaccatcgtgaaccccgtgaaccagggcaagggcgtggtgtacaacagcaagatcgccaggaccgacgtgttcaagaaggacgagaagtactacctgatccccatctacaccatcgacctgctgaagaacatcctgccccagaaggccatcaccgccggcaagggctacgaggactggaccaccatcgaccccagcttcaccttcctgttcagcctgttccccaacgacctgatccagatcgtgcccagcaagaacaagaccatcaaggccaggaccaccgtgagcaagaaggaggtgctgctgcccagcctgaccggctacttcaagggcgtgcacagcggcaccgccggcatcaccgtggagacccacgacggcagcgtgatcgccaacgtgggcagcaagcagctgctgctgttcgagaagtaccaggtggacgtgctgggccactacaccaagatcaaggaggagaagaggatcggcatggtgatctga

SEQ ID NO: 140 - DNA, 3246 bp, synthetic construct
  misc_feature 1..3246: note = source = /note="Description of Artificial Sequence: Syntheticpolynucleotide"
  source 1..3246: mol_type = other DNA
atgcagtacgtgctgggcctggacatcggcatcgccagctgcggctgggccgtgatcaaccaggagaaggagaggatcgaggacctgggcgtgaggatcttcgacaaggccgagaaccccaaggacggcaagagcctggccgcccccaggagggacgccaggagcaccaggaggaccctgaggaggaagaagcacaggatgcagaggatcaagatcctgctggtgaagcacggcctgctgagccagaccgagctggaccacctgtacgagagcgccaccgaggtggacgtgtggaacctgaggctggacgccatcgagaggaagctgaaccccaaggagttcaccagggtgctgatccacctggccaagaggaggggcttcaagagcaacagcaaggagaccaccctgagcgagaacggccagatcctggagagcatcagcgagaaccagcagatcatggagcagaagaactacaagaccatcggcgagatgatcctgaaggacaagaagttcgagaaccacaagaggaacaaggacggcacctacatcggcaccgtgaccaggcagcagctgcaggacgagatccagatcatcttcaacgcccagaggctgtacaagaacaactacgccaccaaggagttcgagagcagctacctggagatctgggccagccagaggccctacgccagcaaggaccagatcgagaagatgatcggctactgcaccctggagcagaaggagaagagggtgcccagggccagctggagcttccagtacttcgtggccctgcacaccatcaacaacctgaggctgatcagcaaggacaggatcgaggagctgagcttcaaggagaagaagcagatcatgaacctggccctggagaagcccatcgtgaagtacatcgacatcaggaagctgctgagcatccccaacgagctgcacttcaacagcctgctgtacagcgccgacaccgtggacaccaccgtggagaacaggaagtgcatcgagctgaaggagtaccacagcatcaacaaggtgtacaagcagatctacggcaagaacgccctgaacctgctgcccatcgactacgacaccatcgcctacggcctgaccatcttcaaggacgacaaggacatcctggagcacctgaagaacaagtacgtgaacgccaagggcaagcccatcaacaacctggccaagaagacctacgacgacaccttcatccaggccctgctgaccctgaacttcagcaagatgggccacctgagcttcaaggccctgaagaacatcatccccttcctggaggagggcctgagctacgacaaggcctgcgagaaggccggctacaacttcaagggcaccagctacaccgagcagaccaagtacctgcccgtgatcccccagaacaccaaccccgtggtgcacagggccctgagccagaccaagaaggtgatcaacgccatcatcaagaagtacggcagccccaacgccatccacatcgagaccgccagggagctgagcaagaccttccaggagaggaaggagatcgacagcatgtaccaggacaacagcaagaagaacgagcacgccatccacaagctgaaggagctgggcaacatcaaccccagcggcatcaacatcgtgaagttcaagctgtggaacgagcaggacggcaagtgcatgtacagcggcaagtacatcgagccccacaggctgttcgaggagggctacaccgaggtggaccacatcctgccctacagcaggagcctggacgacagctacaacaacaagaccctgaccctgggcatcgagaaccagaggaagggcaacaagaccccctacgagtacatgggcaacaccagcatctgggacgagtacgagatcagggtgcagagcaacaagaagatcaacaagaagaagcagcagaagctgctgctgcagcacttcagctacgccagggagcaggagttcatcgagaggaacctgaacgacaccaggtacgccaccatctacctgagcagcctgatccagcagcacctgatcttcagcgagagcagcaggaagaagaaggtgcacaccgtgagcggcatcatcaccagccacctgaggagcaggtggggcttcaacaaggacaggaaggagggccacatccaccacgccctggacgccgtgatcgtggccgtgaccagcgaccacatgatccagagggtgaccaagtactacaagctgaaggagctgaacaggaacctgcaggccaagaggatgcccttccccgagccctgggagggcttcaggctggagctggaggccaggatcagccccaacacccagcagtacctgaagggcctgaggttcaagaactacgccgacgtgaacctgtgcgagatcaagcccatcttcgtgagcaagatgcccaagaggagcatcaccggcgagctgcaccaggagaccatcaggaagttcatcggctacaacgagaagggcaaggtgctgaccgccatcaagaccaagctggaggacatccccttcgacgccaacggcgacttccccatgtacggcaaggagaccgacctgtacacctacaacagcatcaaggagaggtacctgagccacaagaaggacaagaggaagagcttccaggagcccctgtacaagcccaccaagagcggcggcatcggccccctgatcaagagcatcaagatcatggacaccaggaccatcgtgaaccccgtgaaccagggcaagggcgtggtgtacaacagcaagatcgccaggaccgacgtgttcaagaaggacgacaagtactacctgatccccatctacaccatcgacctgatgaagaacatcctgccccagaaggccatcaccgccggcaagggctacgaggactggatcaccatcgaccacagcttcaccttcctgttcagcctgttccccaacgacctgatcaagatcgtgcccagcaagaacaaggagatcaaggccaggagcaccagcagcaagaaggagatcctgctgcccagcctgatcggctacttcaagagcgtgcacagcggcaccgccggcatcaccgtggagagccacgacggcaggttcatcgccaacgtgggcagcaagcagctgctgctgttcgagaagtaccaggtggacgtgctgggccactacaccaagatcaaggaggagaagaggatcggcatggccacctgcaacgacaacaagaagagcaccgccttcggcagcctgtga

SEQ ID NO: 141 - DNA, 4215 bp, synthetic construct
  misc_feature 1..4215: note = source = /note="Description of Artificial Sequence: Syntheticpolynucleotide"
  source 1..4215: mol_type = other DNA
atgaagaagaccctgggcatcgacctgggcaccaacagcatcggctgggtgatcaggaacgccgacctgctggacaaccagatcgaggacttcggcgtgatcaccttcgagaagggcgtggccagcgagaagggcaacgagttccccaaggtgcagaagaggaccgagagcaggggcaagaggaggaactaccagagcgagaagtacaggaagttcgccctgctggccttcctgatccagaagaacatgtgccccctgaccatggacgagttctgcaactggaaggactacaggaagggcaagaagagggagtacccccagagcgaggagttcctgaactggatcaggttcgacttcaacggcgacggcctgcccgacttccacctgttcggcaaggagaaggacgacagctactacgtgttcagggccttcgccgccgacgagaaccacaagaacgtgttcgacaacaacccccacatcctgggcagggtgctgtaccagatggtgcagaggaggggcttcaagggcagggacgaggaggaggccaagaccatgctggtgggcagcgacaagaacggcaccaagggcaggaacgacatcgaggagtacatcgagaagtacaagaccctgggcgccgccctgtactaccaccagaaggacttcggcggcaggatcaagcagaggtacaacctgaggaaggacaacgagaacgagctgaaggagatctgcaagatccaccagctgagccaggaggactacgagaagctgtggaaggccatcatctggcagaggcccctgaggacccagaagggcctggtgggcaactgcatctacgagaagaacaagaagagggtggccgtgagccaccccctgtacgaggagtacaggacctgggtgttcatcaacaacctgaacatcatcccccccttcggcgaggagaagcagaactacatcagcgagaagatctaccccctgttctacaagagcaagcccgacttcgagctgagcgacatcgacaagcagctgaagaaggacggcgccaagaggaccagcaagcacaacgacaagaccaaggtgctgagcgtgaagctgctgaagcagttccaggacgtgttcggcgaggactggaagcagaagctgcagtgggacatcaacggcgacaggaacagccagcccgagaagaaggagaagagcctgtacaccttcgaggacctgtggcacatcctgctgaccttcgacggccaggagaacctgaagaagttcgccctggagaagctgaacctggacgacgagaaggccatcaagttcagcaagatcaagctgcagcagggctacgccaccctgagcatcagcgccatcaagaagatcctgccctacctgcagaggggcttcctgtacagccacgccgtgtacatggccaacctgtacaagatgctgggcgagaccaccatcagcgagaccctgaccaaccacttcagcgacgagatcctgaagatcctggagaacgacgacttcaacaggaagaacagcgccatcatcaacagcctgatcagcgagatgctgaacgacgacaacaggtactacatcgccgacaacaggaacctggacaagaccgaggagcagatcgtgctgaagagcatcaccgacaactacggcctggagacctggggcaacttcgacgaggagaagaagatggagatcatcgacttcgtgagcagcaagtacctggagttcctgaagaagacctacaccgagaagggcaacctgttcatccagcccgagaggatccacgacaagatcttcaacttcctgaaggagacctaccacgtgagcgaggacaagatcaagtacctgtggcaccccagcgagcaggagaactacgccaaggccgacgagtacttcgagtacagcatcggcagcaagaagtactacgtgaaggaggagagcacccagaacttcctgagcaggaaccccaacgccgagttcgacggcaggcagctgaagctgctgggcaaccccgagcccctgagcaagggcttcaagaaccccatggccctgaagagcctgcacaagctgaagaacctggtgaactacctgctgcagaccggcaagatcgacgagggcaccagggtggtgatcgagatcgccagggagctgaacgacaagaacaagaggaaggccatcgagaactggcagaaggacagggagaaggagaacgaggccttcaggaaggagatcgaggtgtacaaggagcagttccccaacatcaacctgatcgacgagaacaccctgatcaggaagatcaggctgtggcacgagcagaacaagatctgcctgtacaccggcaagaccatccccttcagcgagctgatcatcggcaacaagtacgacttcgagcacaccatccccgccagcatcagcttcgacaacgagctgaagaacctgaccatcagcgacagcagctacaacaggctgtacaagggcaagaagttccccacccagctgagcaactacgacagcgagcagaccatcaacggcgagagctgcaacagcatcctgaggaacatcgagttcatcttcggcgagaggatcgtggagtacaaggagatcaagggcaagaccgagaagatcgtgaagtggaagaagatcgacgagctggagaagcagttcgacgagtggaagaagaaggccagctacgccagcaccaaggagatcaaggacaactgcatcgtgaagtaccacaccatcaagatggacctggactacctgaagagcaagctggccaccttcaccatcaccgagtacaaggccggctggaggaacagccagatcagggacacccagatcatcaccaagtacgccctgccctacttcaagaccctgttcaagagggtgagcgtggagaagggcggcgtgaccgacatcttcaagaaggtgtacaaggtgcagagcaggaacagcaagaaggacaggagcgtgcacagccaccacgcccaggacgccgccatcctgaccctgatccccaacgccttccacagggagaggatcatcaaggcctacgagaacgagatcgacaacaggaccggcaagacctaccacgagcagcccctggactgggagaacttcagcgagaagtacatcctggagctgcaggacaaggtgctgatcaacaacctgaccgacaacaggaccatcacccagacctacaagaccgtgaggaagaggggcaaggtggtgtacgacatcgacgagaacggcaacagcctgaagagggtgagcaagggcgacaccatcaggggccagctgcacggcgagaccttctacggcgccatcaagcagcccgtgagggacgaggacaacaagatcctgttcgacgagaacaagaagatgatcctgaaggacgagatctacctggccgtgaggaagcccctggtgtacaagaaggacgccaacagccccggcttcaagaccctggacgaggtggagaaggtgatcgtggacaagggcctgttcaagatgatcaagaagcaggtggaggagagcgacttcaagaccgccctgatcgacggcgtgtacatgctgaacgagagcggcgagaaggtgaacaagatcaggaggatcaggtgcttcgagaacggcctgaagtacaccaccgccatcaaggtgcacgagcacagcttcgtgagccacaaggagtacaagcagagcaccctggccaccaacggcgagaacacctactgcctgttctacaagaacgacaagggcaaggccatgaagatcctgagcatcgtggacctggccgagctgaagctgaagaacatccagaacctgtacaacgagcccgagttcagcagcttcgaggtgggcaagggcaagaacaagtacaagatccccctgtacagcgtgctgaagagcggcgacaaggtgctgttctacaaggagaacatctacgagctgaaggacctggagcagaaggagctgagcgacaggatgttcaagatgtaccagttcgagaaggacggcaggatcaagttcaggcaccacctggccgccggcatcgacaccgagctgaagaaggagaaccccgagaacagcagcgtgaacttcgaggagaagcaggtgttcctgaggctgagccagggccagtggaacttcgccatcgacggcaaggacttcgagatcagcctggacggcaagatcaactggaagttctga

SEQ ID NO: 142 - DNA, 3279 bp, synthetic construct
  misc_feature 1..3279: note = source = /note="Description of Artificial Sequence: Syntheticpolynucleotide"
  source 1..3279: mol_type = other DNA
atgaggtacagcatcggcctggacatcggcaccaccagcatcggcagcgccgtgatcaacaacgacctgcagaggttcgagcacctgggcgtgaggatcttcgacgccgccgagaaccccaaggacggcagcagcctgagcgcccccaggaggctggccaggagcagcaggaagaggctgaggaggaggaagcacagggtggagaggaccaagcagatcctgatcaacaagggcctgctgaccaagacccaggtgaagaacctgtacaacagcaagaacgtgaacctggacgtgtgggacatcagggtgagcggcctggacaggaagctgttcaacgacgagttcgccagggtgctgatccacttcagcaagaacaggggcttcaagagcaacaggaagagcgagctgaaggaggacgacaacggcgccatcctgagcgccgtgaaggagaacaaggagctgatggaggagaagggctacaggaccatcgccgagatgctggtgctggacgagaggtacgagggcaccaagaggaacaaggacggcgactacagccacgtggtgagcaggagcgacatcgagaacgagatcaggctgctgttccagaagcagagggagtacggccaccccttcgccatcgaggagaacgaggaggccttcctggccatctggagcagccagaggcccttcgccaccaaggacgacatcgtgaagaagatcggcacctgcaccctggagcccagggagaagagggcccccaagagcacctacaccttcgagaggttcagggccctggacaagctgaacaggctgaggatcctgagcaccaccacccccagcaggcccctgaccaacgaggagagggacagcatcctgaacagcctgttcagcaagaaggaggtgaagtacaaggagctgaggaagatgctgaagctgaccgacgaccagaggttcaacgagatctactacagccccgacgagaccatcgagaagaccgagaacagggtgttcctgagcagcgagagccagtacaagatcaagaagatcatcgagaagaccgagagcaagaacatgctgagcacctactgccccatcgactacgacaccatcggctacgccctgaccgtgttcaaggacgacaaggacatccagcactacctgcagaacaggtacgtggacagcaagggcaaggccatcagcaacatggccaacagggagtacaacctggagctgatcgaggagctgctgggcctgagcttcagcaagttcggccacctgagcctgaaggccctgaacaacatcctgccctacatggaggagggcgagccctaccacatcgcctgcgagatggccggctaccagttcagccagaggctgaccaaggagaagcacaggctgctgccccccatccccgtggacgagatccccaaccccgtggtggtgagggccctgacccaggtgaggaaggtgctgaacagcatcatcaagaagtacggcccccccagcgacatctacatcgagctggccagggagatgggcaagcccttcaaggagaggaagagcctggagagggagttcaacgagaacaggcaggtgaacgagaaggccaaggcccacatcagcgagctgtacagggtgcccaacgaccccaggccccacgacatcctgaagttcaagctgtggaaggagcagaacggcatctgcccctacagcttcaagcccatcagcgtggactacctgttcaacatcggctacaccgaggtggaccacatcatcccctacagcaggagcttcgacgacagcaacggcaacaaggtgctggtgctgaccaacgagaacaggaacaagctgaacaggaccccctacgagtggttcggccacgacgagaacaggtggggcgacttcgtgagcttcgtgaggaccatgaaggtgggcaagaagaagaaggacatgctgctgaagaagaacttcgacgaggagcaggaggagcagatcctgagcaggaacctgaacgacaccaggtacatcaccaggtacatcaagagcttcatcgaggacaacctggagttcaggaccgaggagaacaagaagcagtacgtgcacaccgtgaacggcggctacaccagcctgatgaggaagaggtggggcctgaacaaggacaggaggggcaacgacctgcaccacgccgtggacgccgccatcatcgccgtgagcctgcccttcaagcacaaggtgaacacctacttcaagaggcaggagatcggcctgagcaacctgagcaacaacaagaaggacatcttccccgagccctggaggaacttcatcaaggagctggaggccaggatgatccaggaccccgagaagatgaagaccgccctggagagcctggagctggagacctacggcgagatcttcctgaacaagctgaagcccatcttcgtgagcaggatgcccaagcacagcatcaagggccagatccacgaggagaccatcaggagggtgaggggcctgaccgaggagggcttcctggtgaccgtgaagaagaccaggctggaccagatccccttcgacaagaacggcgacttccccatgtacggcaaggagaccgacatcaagacctacatggccatcaagcagaggtacctggagtacggccaggacaagcagaaggccttcgccatccccctgaggaagcccagcaagaaccccgagaacgcccccatcgtgaggagcgtgaagatcgagggcaaggccaacagggtggtgatgctggacgacaaggccgccgccgacaacgccagcatcgccaggaccgaggtgttcaggcacaaggagaccggcgagtactacgtgacccccgtgtacgtggccgacatcgtgagcaacaagatccccgacaggctgatcaccctgaagaagccctacagcgagtgggacaggatcaccgacgagtacgagtacctgttcagcctgtacaacaacgacctgatcaagatcgtgctgcccaaggagaaggagaccaagaagtacaccggcggcaaccacctgtggcaggagggcttcttctacttcaagggcgtggacagcagcaacgccagcatcaagatcatcgaccacctgaacagcttcgaggtgaggatcggcatcaggaggctgatcgccttcgagaagtaccaggtgaaccccctgggcgagatcaacaaggtgcacggcgagaagaggcccggcgagctgctgaacgaggaggagatcaaggagaacaggaagaacatcagctga

SEQ ID NO: 143 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgtgaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggtgagcgcctacgccgacgagctggccaccatcctgaagacccagcaggccctgtaccccaacgagctgaccgacgactggatcgccctgttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccgagcagaaggagttcatcctgaccgagctgatgaccaaggagttcgccaggttcggcgtgaacgacatcgccaagctgctgggcgtgaagaaggagcagctgagcggctggaggctggacaagaagggcaagcccgagatccacaccctgaagggctacaggaactggaggaagatcttcgccgaggccggcatcgacctggccaccctgcccaccgagaccatcgactgcctggccaaggtgctgaccctgaacaccgagagggagggcgtggagaacaccctggccttcgagctgcccgagctggccgagcccgtgaagagcctggtgctggaccactacaaggagctgagccagagcatcagcacccaggcctggcacaggttcagcctgaagaccctgcacctgctgatccccgagctgatcaagagcaccagcgagcagaacaccctgctggagcagttccagctgaaggccggcgtgaggaagaggtacagcgactacaagaagctgcccaccaaggaggtgctggccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagcaggcccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaagaagctgaggaagttcaacaccgacatcctgggcaagaagcaccacctgagctacgagaaggagcccaagaacatcatcaag

SEQ ID NO: 144 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgtgaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggcaactaccagctgaacgtgttcaaggtgagcgcctacgccgacgagctggccaccatcctgaagacccagcaggccctgtaccccaacgagctgaccgacgactggatcgccctgttcgtgcagcccggcatcgccgaggacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgagcagcccctgagccccacccagaaggagttcatcctgaccgagctgatgaccaaggagttcgccaggttcggcgtgaacgacatcgccaagctgctgggcgtgaagaaggagcagctgagcggctggaggctggacaagaagggcaagcccgagatccacaccctgaagggctacaggaactggaggaagatcttcgccgaggccggcatcgacctggccaccctgcccaccgagaccatcgactgcctggccaaggtgctgaccctgaacaccgagagggagggcgtggagaacaccctggccttcgagctgcccgagctggccgagcccgtgaagagcctggtgctggaccactacaaggagctgagccagagcatcagcacccaggcctggcacaggttcagcctgaagaccctgcacctgctgatccccgagctgatcaagagcaccagcgagcagaacaccctgctggagcagttccagctgaaggccggcgtgaggaagaggtacagcgactacaagaagctgcccaccaaggaggtgctggccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgcctggatggccggcgccttcaagaagatcaacggcaagttcagcaactgggacgagtaccagaagtgggtggagagcaggcccttcagcaggaagaaggccaacaacctgctggagaccaggaacatcttcgacagcgagcaggtgcagaacttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccatcgacgccagcctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccctgaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatgcccgccgagaaccagttcaagcagaagccctacaacaacggcgccatcaacctgaacatcgccaagtacggcaaggagggcaacaagctgaggaagttcaacaccgacatcctgggcaagaagcaccacctgagctacgagaaggagcccaagaacatcatcaag

SEQ ID NO: 145 - DNA, 3162 bp, synthetic construct
  misc_feature 1..3162: note = source = /note="Description of Artificial Sequence: Syntheticpolynucleotide"
  source 1..3162: mol_type = other DNA
atgaagaggcactacatcctgggcctggacatcggcatcaccagcgtgggctacggcatcatcgactacgagaccagggaggtgatcgacgccggcgtgaggctgttcaaggaggccaacgtggagaacaacgagggcaggaggagcaagaggggcgccaggaggctgaagaggaggaggaagcacaggctgcagagcgtgaagaagctgctgttcgactacgacctgctgaccaaccacagcgagctgagcggcatcaacccctacgaggccagggtgaagggcctgagccagaacctgagcgaggtggagttcagcggcgccctgctgcacctggccaagaggaggggcgtgcacaacgtgaacgaggtggaggaggacaccaggaacgagctgagcaccaaggagcagatcagcaggaacagcaaggccctggaggagaagtacgtggccgagctgcagctggagaggctgaagaccgacagcgaggtgaggggcgccatcaacaggttcaagaccagcgactacgtgaaggaggccaagcagctgctgaaggtgcagaaggagtaccaccagctggaccagagcttcatcgacacctacatcgacctgctggagaccaggaggacctactacgagggccccggcaagggcagccccttcggctggaaggacatcaaggagtggtacgagatgctgatcggccactgcacctacttccccgaggagctgaggagcgtgaagtacgcctacaacgccgacctgtacaacgccctgaacgacctgaacaacctggtgatcagcagggacgacaacgagaagctggcctactacgagaagttccagatcatcgagaacgtgttcaagcagaagaagaagcccaccctgaagcagatcagcaaggagatcttcgtgaacgaggaggacatcaagggctacagggtgaccagcaccggcaagcccgagttcaccaagttcaagatctaccacgacatcaagggcatcaaggagaggaaggagatcatcgagaacgccgaggtgctggaccagatcgccgagatcctgaccatctaccagagcagcgaggacatccaggaggagctggccaagctgaacagcgagctgacccaggaggagatcgagcagatcagcaagctgaccggctacaccggcacccacagcctgagcctgaaggccatcaacctgatcctggacgagctgtggcacaccagcgacaaccagatggccatcttcaacaggctgaagctggtgcccaagaagatggacctgagccagcagaaggagatccccaccaccctggtggacgacttcatcctgagccccgtggtgaagaggagcttcatccagagcatcaaggtgatcaacgccatcatcaagaagtacggcctgcccagcgacatcatcatcgagctggccagggagaagaacagcaaggacgcccagaagctgatcaacgagatgcagaagaggaacaggcagaccaacgagaggatcgaggagatcatcaggaccaccggcaaggagaacgccaagtacctgatcgagaagatcaagctgcacaacatgcaggagggcaagtgcctgtacagcctggaggccatccccctggaggacctgctgaacaaccccttcaactacgaggtggaccacatcatccccaggagcgtgagcttcgacaacagcttcaacaacaaggtgctggtgaagcaggaggagaacagcaagaaggacaacaggacccccttccagtacctgagcagcagcgacagcaagatggactacgagaccttcaagaagcacatcctgaacctgagcaagggcaaggacaggatcagcaagaagaagaaggtgtacctgctggaggagagggacatcaacaggttcagcgtgcagaaggacttcatcaacaggaacctggtggacaccaggtacgccaccagggagctgatgaccctgctgaggagctacttcagcgtgaacaacctggacgtgaaggtgaagagcatcaacggcggcttcaccagcttcctgaggaggaagtggaagttcaagaaggagaggaaccagggctacaagcaccacgccgaggacgccctgatcatcgccaacgccgactacgtgttcaaggagtggaagaagctggacagggccaacaaggtgatggagaaccagaccgtggaggagaaccaggccgagagcatgcccgagatcgagaccgagcaggagtacaaggagatcttcatcaccccccaccagatccagcacatcaaggacttcaaggactacaagtacagccacagggtggacaagaagagcaacagggagctggtgaacgacaccctgtacagcaccaggaaggacgacaagggcaacaccctgatcgtgaacaacctgaacggcctgtacgacaaggacaacgacaagctgaagaagctgatgaaccagagccccgagaagctgctgatgtaccaccacgacccccagacctaccagaagctgaagctgatcatggagcagtacggcggcgagaagaaccccctgtacaagtaccacgaggagaccggcaactacctgaccaagtacagcaagaaggacaacggccccgtgatcaagaagatcaagtactacggcaacaagctgaacgtgcacctggacatcaccgacgactaccccaacagcaggaacaaggtggtgaagctgagcctgaagcccttcaggttcgacgtgtacctggacaacggcgtgtacaagttcgtgaccatcaagaacctggacgtgatcaagaaggaggactactacgaggtgaacagcaagtgctacaaggaggccaagaagctgaagcagatcagcgaccaggccgagttcatcgccagcttctacaacaacgacctgatcaaggtgaacggcgagctgtacaggatcatcggcgtgaacaacgacctgctgaacaggatcgaggtgaacatggtggacatcacctacaaggagtacctggagaccatgaacgacaagaggacccccaggatcttcaaggccatcaccggcaagacccagagcatcaagaagtacagcaccgacatcctgggcaacctgtacgaggtgaagagcaagcagaacccccagatgatcatgaagaggtga

SEQ ID NO: 146 - DNA, 3156 bp, synthetic construct
  misc_feature 1..3156: note = source = /note="Description of Artificial Sequence: Syntheticpolynucleotide"
  source 1..3156: mol_type = other DNA
atggtgaccaagtacatcctgggcctggacatcggcatcaccagcgtgggctacggcatcatcaactacgaggacaagaccatcatcgacgccggcgtgaggctgttccccgaggccaacgtggagaacaacgagggcaggaggagcaagaggggcgccaggaggctgaagaggaggaggatccacaggctggacaggatcaagcagctgctgagcgagtacaacctggtggacctggacaacatcccccagagccccagcccctacgagatcagggtgaagggcctgagggaggagctgagcaaggacgagctggtgatcgccctgctgcacatcgccaagaggaggggcatccacaacgtggaggccgtggacgagacccaggacgagggcaacgagctgagcaccaaggagcagctggccaagaacaacaacctgctgaaggacaagtacgtgtgcgagctgctgctggagaggctgaaggacggcaaggtgaggggcgagaagaacaggttcaagaccaccgacatcatcaaggaggtgaagcagctgctggagacccagaaggaggcccaccagctggacgacgacttcatcaacaggtacatcgacctgatcgagaccaggagggagtacttcgagggccccggcaagggcagccccttcggctggggcggcgacctgaagaagtggtacgagaccctgatgggccactgcacctacttccccaacgagctgaggagcgtgaagtacagctacagcgccgacctgttcaacgccctgaacgacctgaacaacctggtgatccagagggagggcaacagcaagctggagtaccacgagaagtaccacatcatcgagaacgtgttcaagcagaagaagaagcccaccctgaagcagatcgccaacgagatcggcgtgagccccgacgacatcaagggcttcaggatcaacaagagcggcaaggagaccttcaccgagttcaagctgtaccacgacctgaagaaggtgctgatcgaccagagcatcctggagaacgtgcagctgctggaccagatcgccgagatcctgaccatctaccaggacaaggagagcatcatcaacgagctgaaccagctgagcgagatcatcaacgagcaggacaaggagagcatcagcaacctgagcggctacaacggcacccacaggctgagcctgaagtgcatcaacctggtgatcgaggagctgtggcacaccagcaggaaccagatggagatcttcacctacctgaacatcaagcccaagaagatcgacctggccaagaccaacaagatccccaagaacatgatcgacgagttcatcctgagccccgtggtgaagaggaccttcggccaggccatcaacgtgatcaacaaggtgatcgagaagtacggcgtgcccgaggacatcatcatcgagctggccagggagagcaacagcaaggacaagcagaagttcatcaacagcctgcagaagaagaacgagaccaccaggaagaggatcaacgagatcatcggccagtacggcaaccagaacgccaagaggctggtggagaagatcaggctgcacgacgagcaggagggcaagtgcctgtacagcctggagagcatccccctggaggacctgatcaacaacccccagtactacgaggtggaccacatcatccccaggagcgtgagcttcgacaacagctaccagaacaaggtgctggtgaagcagaccgagaacagcaagaagagcaacaggaccccctaccagtacttcaacagcggcgagaccaagctgagctacaaccagttcaagcagcacgtgctgaacctgagcaagagcaaggacaggatcagcaagaagaagaaggagtacctgctggaggagagggacatcaacaagtacgaggtgcagaaggagttcatcaacaggaacctggtggacaccaggtacgccaccagggagctgaccaactacctgaaggcctacttcagcgccaacgacatggacgtgaaggtgaagaccatcaacggcagcttcaccgactacctgaggaaggtgtggaagttcaagaaggagaggaaccacggctacaagcaccacgccgaggacgccctgatcatcgccaacgccgacttcctgttcaaggagaacaagaagctgaagaaggccaacgccatcctggagcagcccagcctggacaacggcaagagcgacgccaccgtggagaacgacaacgagtacgtggagaccttcagcatccccaagcaggtgaacgacatcaaggagttcagggacttcaagttcagccacagggtggacaagaagcccaacaggcagctgatcaacgacaccctgtacagcaccaggaagatcgagaaccacaccttcatcgtgagccccatcaccaacatctacagcaaggacaacgacgagctgaagaagaagttcaacaagaaccccgagaagttcctgatgtaccagcacgaccccaagaccttcgagaagctggaggtgatcatgaagcagtacgccaacgagaagaaccccctggccaagtaccacgaggagaccggcgagtacctgaccaagtacagcaagaagaacaacggccccatcgtgaagaccatcaaggtgctgggcgacaaggtgggcaagcacctggacgtgacccacaagtacaagtacagcaacagcaagatcgtgaagaagaccatcaacccctacaggttcgacgtgtacctgaccgacaagggctacaagttcatcaccatcagctacctggacgtgctgaagaaggacaactactactacatcctgaaggagaagtacgaggagctgaagatcaagaagagcatcagcgacaccgaccagttcatcggcagcttctactacaacgacctgatcaagatcaacgaccagatcttcaaggtggtgggcgtgaacaacgacctgctgaacaggatcgagctggacctgctggacatcagctacaaggagtactgcaagatcaacaacatcaagaccaacaggatcatcaagggcatcaccaagaagatcaccaacatcgagaagttcagcaccgacgtgctgggcaacctgtacaaggcccacagcaaccacccccagctgatcttcaagcagagggac

SEQ ID NO: 147 - DNA, 3387 bp, synthetic construct
  misc_feature 1..3387: note = source = /note="Description of Artificial Sequence: Syntheticpolynucleotide"
  source 1..3387: mol_type = other DNA
atgagcaacggcaagatcctgggcctggacatcggcgtggccagcgtgggcgtgggcatcatcgacgccaagaccggcaacgtgatccacgccaacagcaggctgttcagcgccgccaacgccgagaacaacgccgagaggaggggcttcaggggcgccaggaggctgaccaggaggaagaagcacagggtgaagagggtgagggacctgttcgagaagtacgacatcagcaccgacttcaggaacctgaacctgaacccctacgagctgagggtgaagggcctgaccgagcagctgaccaacgaggagctgttcgccgccctgaggaccatcgccaagaggaggggcatcagctacctggacgacgccgaggacgacagcaccggcagcagcgactacgccaagagcatcgacgagaacaggaggctgctgaagaccaagacccccggccagatccagctggagaggctggagaagtacggccagctgaggggcaacttcaccgtgtacgacgagaacggcgaggcccacaggctgatcaacgtgttcagcaccagcgactacaagaacgaggccaggaagatcctggaggcccagagcaactacaacaagcagatcaccgacgagttcatcgaggactacatcgagatcctgacccagaagaggaagtactaccacggccccggcaacgagaagagcaggaccgactacggcaggttcaggaccgacggcaccaccctggagaacatcttcggcatcctgatcggcaagtgcagcttctaccccgaggagtacagggccagcaaggccagctacaccgcccaggagttcaacttcctgaacgacctgaacaacctgaaggtgcccaccgagaccggcaagctgagcaccgagcagaaggagtacctggtggacttcgccaagaagagcaaggccctgggcgccagcaagctgctgaaggagatcgccaagatcgtggactgcagcgtggacgacatcaagggctacagggtggacaacaaggacaagcccgacctgcacaccttcgagccctacaggaagctgaagttcaacctgagcagcatcgacatcgacgagctgagcagggagaccctggacaagctggccgacatcctgaccctgaacaccgagagggagggcatcgaggacaccatcaagaggaacctgcccagccagttcaccgaggagcagatcagcgagatcgtgcagatcaggaagaaccagagcagcgccttcaacaagggctggcacagcttcagcgccaagctgatgaacgagctgatccccgagctgtacgtgaccagcgaggagcagatgaccatcctgaccaggctggagaagttcaaggtgaacaagaagagcagcaagaacaccaagaccatcgacgagaaggagatcaccgacgagatctacaaccccgtggtggccaagagcgtgaggcagaccatcaagatcatcaacgccgccgtgaagaagtacggcgacttcgacaagatcgtgatcgagatgcccagggacaagaacgccgaggacgagaagaagttcatcgacaagaaggagaaggagaacaagaaggagaaggacgacagcctgaagagggccgccttcctgtacaacggcaccgacaacctgcccgacggcgtgttccacggcaacaaggagctgaagaccaagatcaggctgtggtaccagcagggcgagaggtgcctgtacagcggcaagctgatcagcatccacgacctggtgcacaacagcaacaagttcgagatcgaccacatcctgcccctgagcctgagcttcgacgacagcctggccaacaaggtgctggtgtacgcctggaccaaccaggagaagggccagaagaccccctaccaggtgatcgacagcatggacgccgcctggagcttcagggagatgaaggactacgtgctgaagcagaagaggctgggcaagaagaagagggagtacctgctgaccaccgagaacatcgacaagatcgaggtgaagaagaagttcatcgagaggaacctggtggacaccaggtacgccagcagggtggtgctgaacagcctgcagaccgccctgaaggagctgggcaaggacaccaaggtgagcgtggtgaggggccagttcaccagccagctgaggaggaagtggaacatcgacaagagcagggagacctaccaccaccacgccgtggacgccctgatcatcgccgccagcagccagctgaagctgtggcagaagcaggagaaccccatgttcgagagctacggcgagaaccaggtggtgaacaaggagaccggcgagatcctgagcatcagcgacgacaagtacaaggagctggtgttccagcccccctaccagggcttcgtgaacaccatcagcagcaagggcttcgaggacgagatcctgttcagctaccaggtggacagcaagttcaacaggaaggtgagcgacgccaccatctacagcaccaggaaggccaagctgggcaaggacaagaaggacgagacctacgtgctgggcaagatcaaggacatctacagccaggacggcttcgacaccttcatcaagaggtacaagaaggacaagacccagttcctgatgtaccagaaggaccccctgacctgggagaacgtgatcgaggtgatcctgagggactaccccagcgagaagctgagcgaggacggcaagaagaccgtgaagtgcaaccccttcgaggagtacaggagggagaacggcctgatctgcaagtacagcaagaagggcaacggcacccccatcaagagcctgaagtactacgacaagaagctgggcaactgcatcgacatcacccccgagaagagcaagaacagggtggtgctgaggcagatcagcccctggagggccgacatctacttcaacctggagaccctgaagtacgagctgatgggcctgaagtacagcgacctgagcttcgagaagggcaccggcaagtaccacatcagccaggagaagtacgacgccatcagggagaaggagggcatcggcaagaagagcgagttcaagttcaccctgtacaggaacgacctgatcctgatcaaggacaccctgaacaactgcgagaggatgctgaggttcggcagcaagaacgacaccagcaagcactacgtggagctgaagcccctggagaagggcaccttcgacagcgaggaggagatcctgcccgtgctgggcaaggtggccaagagcggccagttcatcaagggcctgaacaagaccaacatcagcatctacaaggtgaggaccgacgtgctgggcaacaagttcttcatcaagaaggagggcgacaagcccaagctggacttcaagaacaacaacaag

SEQ ID NO: 148 - DNA, 4077 bp, synthetic construct
  misc_feature 1..4077: note = source = /note="Description of Artificial Sequence: Syntheticpolynucleotide"
  source 1..4077: mol_type = other DNA
atggagaaggtgccctacaacatcggcctggacatcggcaccagcagcatcggcttcgccgccaccgacaacctgaacaagcccatcagggccaagggcaagaccgtgatcggcgtgaggctgttcgaggagggcaagaccgccgccgacaggaggggcttcaggaccaccaggaggaggctgagcaggaggaagtggaggctgaggctgctggacgagatcttcgacaaggagatggccaaggtggacaacaccttcttcgccaggctgaaggagagcaacctgagccccaaggacgccaacaagaagtacctgggcagcctgctgttccccgagaagaaggacttcaagttctacgaggactaccccaccatctaccacctgaggtacgccctgatgcacgagaagaggcagttcgacatcagggaggtgtacctggccatgcaccacatcatcaagtacaggggcaacttcctgaacagcgcccccatgaacagcttcaagacccaggacttcgacttcgtggccaagttcaagaagctgaacgagctgttcgagagcatcgacgccgagcacgagaccaagttcgacatcgagaacatcagcaagttcagggacatcatgctgaaccaggacatcaggaagctggacaggaagaagcaggccgccaagatcctgatcctggacagcaccgacaagaccgccaagaagatcaacaacaagatcgccaccgccgtggccaacagcgccctgggctacaagttcgccctggacgccatcctgaagctggacgtggaggagagcaaggactggagcatcagcctgaacgacgaggagatcgacagcatcctggacaacctgaccagcgacctggacgccgagaggatcgagatcatcgagatcctgagggacctgtacagccacatcgccctgaacgagatcgtgcccaacggccagagcctgagcaagagcatgatggacaagtacgacaagcaccacgccgacctggacgtgctgaagaaggtgatcagcaacatggacgacaggaagaaggccaagagcctgaagaacatctacaaccagtacgtgggcaagaccaacgacaaggtgctggacaaggacgagttctacaagcagatccagaagaacctggacaagagcgaggacgccatgaagatcgtgaacgagatcgagctggaccagttcatgcccaagcagaggaccagccagaacggcgtgatcccccaccagctgcaccagaaggagctggacgagatcatcgagaaccagaagcagtactaccccttcctggccgagcccaaccccaacgagaagaggaagccccacgcccagttcaagctggacgagctgatcgccttcaagatcccctactacgtgggccccctgatcaccaaggaggagcagcaggcccagagcggcgccaagttcgcctggatgaagaggaagcaggacggcgtgatcaccccctggaacttcgacgagaaggtggacaggatggccagcgccaacgagttcatcaggaggatgaccaccaaggacacctacctgctgggcgaggacgtgctgcccgacgagagcctgatctaccagaagttcaaggtgctgaacgagctgaacaacgtgaaggtgaacgacaagaagctgaccgtggccgacaagcaggacatcttcaacgacctgttcaagaagcagaagaccgtgagcgtgagcaagctgcagaagtacttcgtgaccgagaagcactacctgaccgagcccaccatcaagggcctgagcgacaccaagaagttcagcaacagcctgagcacctacatcgacttcgagaagatcttcggcaacgagatcctggccgaccagaacaagcagaacgacctggagaagatcatcgagtggagcaccatcttcgaggacaggaagatcttcgaggacaagctgcacgagatcgagtggctgaccgagaagcagatcaaggccatcaggaggtacaggggctggggcaggctgagcaagaagctgctggtggacctgaggaacaacgagggcaagagcatcctggacgagctgtggaggaccaacgacaacttcatgcagatccaggccagggaggagttcgccaagagcatcgtggaggccaaccagaagctgatgaacctgggcggcgccgccagcgtgcagaacaccgtggagagcaccctggaggacgcctacaccagcccccagaacaagaaggccatcaggcaggtgatcaaggtggtggaggacatcgtgaaggccgtgggctacgcccccgagaagatcaccatcgagttcaccaggggcgccgacaagaacagcaggaggacccagaacaggcagaagcagatcatggaggtgtacaagaccgccgccaaggagatcgtggacgccaccctgaagggccagctggagaacgaggagaagctgaccgacaagctgtacctgtacttcacccagctgggcaaggacatctacagcggcgagaccatcaacatcgaccagctgaacaactacgacatcgaccacatcctgccccaggccttcatcaaggacgacagcctggacaacagggtgctgaccagcagggacctgaacaacggcaagagcgacagcgtgcccgtgaagcagttcggcgccaacatgaagagcttctggatgaggctgcaggcccacggcctgatcagcaagaggaagctgaacaacctgatgaccgaccccgacagcatcggcaagtacaccatgcagggcttcgtgaggaggcagctggtggagaccagccaggtgatcaagctgaccgccaacatcctgggcgccgtgtacggcgagaacaccgacatcgtggagatccccgccaagctgacccaccagatgagggagaagttcaacctgtacaaggtgagggaggtgaacgactaccaccacgccttcgacgcctacctgaccaccttcgtgggcaactacctgttcaagaggtaccccaagctgaggccctacttcgtgtacggcgacttcaagatgaccgacaacgccctgaagggcatgaggaggttcaacttcctgcacgacctgaaggacgacgaggtgctggtggacaacgagaccggcgaggtgctgtgggagggccagaagagcatcgaggagctgaagaagatctacggctacaagttcatgctgaccacccacgaggcctacatcaacaacggcgccatgtacgaccagaccgtgtaccccgccaagagcaacaagaagctgatccccagcaagaacaacaggcccaccaacatctacggcggcttcagcggcaacaaggacgcctacctggccatcgtgaagatcctgggcaagaagggcgacacctacaaggtggtgggcgtgcccaggaggttcagcgacgagctgctgaacgcctacaacgacgactacagcgagtacctgaacaagctgcacgacgtgctggtgacccagttcaccaagaagcagaggaacaagaagaccggcaagatcatcaagaagatcgagaacttcgagatcgtggtgggcaaggtgaactacaggcagaggatcatcgacaggaaccagagcttcatgctgggcagcagcacctacaagtacaacaccaagcagctggtgctgaccgagagcagcatgaagatcctgagcaacttcaagcacgccagcgacgacaacctgaacctggtgtacgacgagatcctggagaaggtgaacgagagcttcgagctgtacgacaagaacggcttcaggaagaagctgaacaacaacatcgacaagttcaggaagctgccctgcaagagcatcttcgagaagaacaagctgatcagcgtgggcaagtgcgagatcctgttccagatcctgaacggcctgcacgccaacgccaccatgggcgacctgaagggcatcggcttcagcacccccttcggcttcatgcaggacgccagcggcatcaagctgaacaaggacagcatgctgctgtaccagagccccaccggcctgttcgagaggaaggtgaagctgagcgacctg

SEQ ID NO: 149 - DNA, 4464 bp, synthetic construct
  misc_feature 1..4464: note = source = /note="Description of Artificial Sequence: Syntheticpolynucleotide"
  source 1..4464: mol_type = other DNA
atggccaagcagaagtacaccgtgggcctggacatcggcaccaacagcgtgggctgggccgtgatcaacaaggacttcaagctggtgagcggcaagaagcacatcaacgacaacggcaagcagaagaggagcaggaccaacctgtggggcgtgaggctgttcgacgccgccgacaccgccgccgacaggaggctgaagaggggcatgaggaggaggatcgccaggaggaaggagaggctgaactacctgaggggcatcttccaggccgacatcctggccttcgacgacagcttcttcatcaggatggacgagagcttcctgcaggacgacgacaagcaggccaccgccttcagctacagggaccagagcggcgccatgcagaccagggtggtgaccgagaaggaggccgtgaagtaccccctgttcaacggcaagagcggcagcggcgagacctacaccgacgagagcgcctactacaaccagtaccccaccatctaccacctgaggcagaggctgatcgacaaccccgcccaggccgacctgaggctggtgtacctggccatgcaccacatcctgaagtacaggggccacttcgtgaaccagggccagaccttcgacctgggcaacatcaacatcgccggcaacctgaccagcgccctggacaagctggacgaggccagcagcttcaagttcggcctggccgacgtggacgccgaccaggccaacgccatcctgaagaacaagcagtggagcgccagcaagaaggcctacgagctgaacaccctgtacgagatcatccaggacaccgtgtacaggagggagaacgagacccaggccgtggcctacgacagcctgaccgtgaagcagcaggagaagtggctggccgagaagcagaagcaggtgaaggccttcctgaccggcatcgtgggcaacaccatcagccccaaggacatcttcgccaacaaggactacgacaggaagcagaacgaggacttccccgagaagatcaagtacagcaacgagaacttcgaggagcagatcggcgagctggagaagtacctggacgagaccgaggtggccgccatcgtggccggcaaggacgtgtacgagagcctggtgctgagcaacatcctgaccaagagcaccctgagcggcagcatgatcgagaagtacaacgtgcacggcacccagctgaagagcctgaagagcttcagcaggaaggtgagcgccgagttctacgacaagctgttcaacgtggtgaaggacgagaagggcaagccccagatcggcgtgtacgcccagtacatcgacggcgtgggcaaccccgccaagaggctggccagggaggacttctacgacgccctgaagaaggtgttcgagagcgagttcaagggcctgaccttccccgccggcgagaagggcatcgacttcaccaagaccgacctgagcgccgacaggatggccttcatcagggagatgaacgaggccatcaacctggagaactacctgcccaagcagaggcaggccgacaacggcgccatcccctaccaggtgcacgagcacgagctgatcaggatcatcgagaaccagaagcagtactaccccttcctgggcgacaaggtgcaggtgacctacgaggacgagagcggccagacccaggtgaggagcgagtacaagatccaggtgctgttcaagttcaggatcccctactacgtgggcaccctggccaagaacagcggctgggtgaacgaggacggcaagaagctggtggccaggaacgtggccgccaagaacagctgggtggtgaggaacagcgacgagagggtgaccccctggaacttcgagcaggtgatcaacaaggaggccagcagcatcaacttcatcgagaggatgaccaacttcgacacctacctgcccaacgagaaggtgctgcccaagaacagcctgctgtaccaggagttcatcgtgaacaacgagctgatcagcagcggctactacctgaacggcaggaaggagtacttcctgcccgagcagaggcagaggatcatcaccaggctgttcaagaggtacaggaaggtgagcgccaagcagatgctggacttcctgaagaacgagtaccagatcaagctggacgacgaccccaagaagctgttcggcctggacaccttcgtgaaggtgcccagctacaacggcagcctgagcaccgtggtggacctgaccaacaagatgggcatcagcgaggacctgatcgccaactaccccgagaggttcgaggagatcatcaagtggcagaccatcttcgaggacaagaagatcctgaagaagaccatcagggaggtgaaccacaacaagtggagcggcatgctgaccgccgagcaggtgaacaagctgagcaagaggcactacaccggctggggcaggctgagccagaagctgctggacggcgtgaagaccagccagggcaggaccatcatcgagagcctgagggagggcatctgcgacaacttcatgaggctgatcgaggacgagaagatcgccgagttcatcgccaacgcccaggtggccggcgccaaggacggcgtgctggcctacgacctggtggaccagctgcccggcagccccgccatcaagaagggcatctggcagagcctgagggtgctgcaggagctggagcactacctgggcagggacgccatcggcaaggtggtgatcgagatgagcagggacgacgagagcagcaggaggaccaaggccaggaagcagcagctggaggagttctacaagaagttcaaggagagcaccggcagcgacgtgaccgccgagctgaagagggagctgagcgagaaggacgccaaggagatcgacgacgagaaggtgttcctgtacttcctgcagaacggcaagagcatgtacagcggcgaccagctgtacctgagcaggctggccgactaccaggtggaccacatcgtgccccagacctacatcaaggacgacagcctggacaacaaggtgctggtgacccagagggacaaccagaacaagggcggcgacacccccagccacaccgtggtgaccaggatgaacagctactgggacatgctggccaagaacggccaggtgagccccaggaagctggccaacctgaagaagggcaccatcaccctgaagcagagggagggcttcatcaacaggcagctggtggagaacaggcagatcatcaagcacgtggccaacatcctgaccaactactacaccggcaccgacaccctggtgctgacccccaagagcggcctgaccagccagctgaggagcggcctgatctacgagctgaaccccgccttcgacgaggccaaggccctggacaggggcaaggcctaccaggtggagaggtacaccaccgtgaagctgcacgacaggttcgtgaagaacaggaagctgaacgactaccaccacgcccacgacgcctacctgaacgccttcgtggcccagtacgtgtaccaggagcaccccgagtggaagaacgcctgggtgtacggcaagtaccccaggaacggccaggccgacttcggcaagtgggccacccagaggaagcagaagagcctgcagctgctgagcagcatggccaacgacgtgtggaacctggaggaccccgacaccatggagaagaccatcctgaacagggacgagaccttcgagcagatgaggcagaccctgtgctacaggaacatcaacatcgtgaagaagctggagacccagaccggcaagttcggcgacgagagcgtgtacaagaagggcaacaaggccgaccactacagcctgggcctgaagaggaagtaccccccccagaagtacggcggcaccaagggcgccatcagcgccgtgaccgccctggtgaaggacaacagcggcagggtgatccccgtgagcatcagcgccagcgactacgacagctaccagaacgccagcgacaagctggcctggctgctgatgaggaagaagaacatcgccgagatcctggtggccagcctgcccaagtacaccaagtacgagctgcccagcggcgccctgaggctgctggccagctaccaggaggcccagagcgccgtggagctgcccatgctgaacctgggcctgatggacgacgaggccaaggtgctgaacctgtacgaccagctggcccagttcatcgccgacaacaagctgttcaccgacaagaagatcgccctgctgaagggcgagatgagggtggccttcgagggcctggaggagttcaaggacaagcagaaggtgatcgacgagctgctgggcgtgaccaacggcagcaaccagggcctgcaggccctgaacagcatcggcctgggcaccagcaaccagaggctgaagagcggcaacaccatgaccaacggcgtgaccctgatcaacgagagcgtgaccggcctgtacagcaccaggaccacctacaac

SEQ ID NO: 150 - DNA, 4011 bp, synthetic construct
  misc_feature 1..4011: note = source = /note="Description of Artificial Sequence: Syntheticpolynucleotide"
  source 1..4011: mol_type = other DNA
atgaagaaggactacgtgatcggcctggacatcggcaccaacagcgtgggctgggccgtgatgaccgaggactaccagctggtgaagaagaagatgcccatctacggcaacaccgagaagaagaagatcaagaagaacttctggggcgtgaggctgttcgaggagggccacaccgccgaggacaggaggctgaagaggaccgccaggaggaggatcagcaggaggaggaacaggctgaggtacctgcaggccttcttcgaggaggccatgaccgccctggacgagaacttcttcgccaggctgcaggagagcttcctggtgcccgaggacaagaagtggcacaggcaccccatcttcgccaagctggaggacgaggtggcctaccacgagacctaccccaccatctaccacctgaggaagaagctggccgacagcagcgagcaggccgacctgaggctgatctacctggccctggcccacatcgtgaagtacaggggccacttcctgatcgagggcaagctgagcaccgagaacatcagcgtgaaggagcagttccagcagttcatgatcatctacaaccagaccttcgtgaacggcgagagcaggctggtgagcgcccccctgcccgagagcgtgctgatcgaggaggagctgaccgagaaggccagcaggaccaagaagagcgagaaggtgctgcagcagttcccccaggagaaggccaacggcctgttcggccagttcctgaagctgatggtgggcaacaaggccgacttcaagaaggtgttcggcctggaggaggaggccaagatcacctacgccagcgagagctacgaggaggacctggagggcatcctggccaaggtgggcgacgagtacagcgacgtgttcctggccgccaagaacgtgtacgacgccgtggagctgagcaccatcctggccgacagcgacaagaagagccacgccaagctgagcagcagcatgatcgtgaggttcaccgagcaccaggaggacctgaagaacttcaagaggttcatcagggagaactgccccgacgagtacgacaacctgttcaagaacgagcagaaggacggctacgccggctacatcgcccacgccggcaaggtgagccagctgaagttctaccagtacgtgaagaagatcatccaggacatcgccggcgccgagtacttcctggagaagatcgcccaggagaacttcctgaggaagcagaggaccttcgacaacggcgtgatcccccaccagatccacctggccgagctgcaggccatcatccacaggcaggccgcctactaccccttcctgaaggagaaccagaagaagatcgagcagctggtgaccttcaggatcccctactacgtgggccccctgagcaagggcgacgccagcaccttcgcctggctgaagaggcagagcgaggagcccatcaggccctggaacctgcaggagaccgtggacctggaccagagcgccaccgccttcatcgagaggatgaccaacttcgacacctacctgcccagcgagaaggtgctgcccaagcacagcctgctgtacgagaagttcatggtgttcaacgagctgaccaagatcagctacaccgacgacaggggcatcaaggccaacttcagcggcaaggagaaggagaagatcttcgactacctgttcaagaccaggaggaaggtgaagaagaaggacatcatccagttctacaggaacgagtacaacaccgagatcgtgaccctgagcggcctggaggaggaccagttcaacgccagcttcagcacctaccaggacctgctgaagtgcggcctgaccagggccgagctggaccaccccgacaacgccgagaagctggaggacatcatcaagatcctgaccatcttcgaggacaggcagaggatcaggacccagctgagcaccttcaagggccagttcagcgaggaggtgctgaagaagctggagaggaagcactacaccggctggggcaggctgagcaagaagctgatcaacggcatctacgacaaggagagcggcaagaccatcctggactacctgatcaaggacgacggcgtgagcaagcactacaacaggaacttcatgcagctgatcaacgacagccagctgagcttcaagaacgccatccagaaggcccagagcagcgagcacgaggagaccctgagcgagaccgtgaacgagctggccggcagccccgccatcaagaagggcatctaccagagcctgaagatcgtggacgagctggtggccatcatgggctacgcccccaagaggatcgtggtggagatggccagggagaaccagaccaccagcaccggcaagaggaggagcatccagaggctgaagatcgtggagaaggccatggccgagatcggcagcaacctgctgaaggagcagcccaccaccaacgagcagctgagggacaccaggctgttcctgtactacatgcagaacggcaaggacatgtacaccggcgacgagctgagcctgcacaggctgagccactacgacatcgaccacatcatcccccagagcttcatgaaggacgacagcctggacaacctggtgctggtgggcagcaccgagaacaggggcaagagcgacgacgtgcccagcaaggaggtggtgaagaagatgaaggcctactgggagaagctgtacgccgccggcctgatcagccagaggaagttccagaggctgaccaagggcgagcagggcggcctgaccctggaggacaaggcccacttcatccagaggcagctggtggagaccaggcagatcaccaagaacgtggccggcatcctggaccagaggtacaacgccaagagcaaggagaagaaggtgcagatcatcaccctgaaggccagcctgaccagccagttcaggagcatcttcggcctgtacaaggtgagggaggtgaacgactaccaccacggccaggacgcctacctgaactgcgtggtggccaccaccctgctgaaggtgtaccccaacctggcccccgagttcgtgtacggcgagtaccccaagttccaggccttcaaggagaacaaggccaccgccaaggccatcatctacaccaacctgctgaggttcttcaccgaggacgagcccaggttcaccaaggacggcgagatcctgtggagcaacagctacctgaagaccatcaagaaggagctgaactaccaccagatgaacatcgtgaagaaggtggaggtgcagaagggcggcttcagcaaggagagcatcaagcccaagggccccagcaacaagctgatccccgtgaagaacggcctggacccccagaagtacggcggcttcgacagccccgtggtggcctacaccgtgctgttcacccacgagaagggcaagaagcccctgatcaagcaggagatcctgggcatcaccatcatggagaagaccaggttcgagcagaaccccatcctgttcctggaggagaagggcttcctgaggcccagggtgctgatgaagctgcccaagtacaccctgtacgagttccccgagggcaggaggaggctgctggccagcgccaaggaggcccagaagggcaaccagatggtgctgcccgagcacctgctgaccctgctgtaccacgccaagcagtgcctgctgcccaaccagagcgagagcctggcctacgtggagcagcaccagcccgagttccaggagatcctggagagggtggtggacttcgccgaggtgcacaccctggccaagagcaaggtgcagcagatcgtgaagctgttcgaggccaaccagaccgccgacgtgaaggagatcgccgccagcttcatccagctgatgcagttcaacgccatgggcgcccccagcaccttcaagttcttccagaaggacatcgagagggccaggtacaccagcatcaaggagatcttcgacgccaccatcatctaccagagcaccaccggcctgtacgagaccaggaggaaggtggtggac

SEQ ID NO: 151 - DNA, 4020 bp, synthetic construct
  misc_feature 1..4020: note = source = /note="Description of Artificial Sequence: Syntheticpolynucleotide"
  source 1..4020: mol_type = other DNA
atgaagaaggagtacaccatcggcctggacatcggcaccaacagcgtgggctggagcgtgctgaccgacgactacaggctggtgagcaagaagatgaaggtggccggcaacaccgagaagagcagcaccaagaagaacttctggggcgtgaggctgttcgacgagggccagaccgccgaggccaggaggagcaagaggaccgccaggaggaggctggccaggaggaggcagaggatcctggagctgcagaagatcttcgcccccgagatcctgaagatcgacgagcacttcttcgccaggctgaacgagagcttcctggtgcccgacgagaagaagcagagcaggcaccccgtgttcgccaccatcaagcaggagaagagctaccaccagacctaccccaccatctaccacctgaggcaggccctggccgacagcagcgagaaggccgacatcaggctggtgtacctggccatggcccacctgctgaagtacaggggccacttcctgatcgagggcgagctgaacaccgagaacagcagcgtgaccgagaccttcaggcagttcctgagcacctacaaccagcagttcagcgaggccggcgacaagcagaccgagaagctggacgaggccgtggactgcagcttcgtgttcaccgagaagatgagcaagaccaagaaggccgagaccctgctgaagtacttcccccacgagaagagcaacggctacctgagccagttcatcaagctgatggtgggcaaccagggcaacttcaagaacgtgttcggcctggaggaggaggccaagctgcagttcagcaaggagacctacgaggaggacctgcaggagctgctggagaagatcggcgacgactacatcgacctgttcgtgcaggccaagaacgtgtacgacgccgtgctgctgagcgagatcctgagcgacagcaccaagaacaccagggccaagctgagcgccggcatgatcaggaggtacgacgcccacaaggaggacctggtgctgctgaagaggttcgtgaaggagaacctgcccaagaagtacagggccttcttcggcgacaacagcgtgaacggctacgccggctacatcgagggccacgccacccaggaggacttctacaagttcgtgaagaaggagctgaccggcatcaggggcagcgaggtgttcctgaccaagatcgagcaggagaacttcctgaggaagcagaggaccttcgacaacggcgtgatcccccaccagatccacctgaccgagctgagggccatcatcgccaaccagaagaagcactaccccttcctgaaggaggagcaggagaagctggagagcctgctgaccttcaagatcccctactacgtgggccccctggccaagaagcaggagaacagccccttcgcctggctgatcaggaagagcgaggagaagatcaagccctggaacctgcccgagatcgtggacatggaggacagcgccgtgaggttcatcgagaggatgatcaacaccgacatgtacatgccccacaacaaggtgctgcccaagaacagcctgctgtaccagaagttcagcatctacaacgagctgaccaaggtgaggtaccaggacgagaggggccagatgaactacttcagcagcatcgagaagaaggagatcttccacgagctgttcgagaagaacaggaaggtgaccaagaaggacctgcaggagttcctgtacctgaagtacgacatcaagcacgccgagctgagcggcatcgagaaggccttcaacgccagctacaccacctaccacgacttcctgaccatgagcgagaacaagagggagatgaagcagtggctggaggaccccgagctggccagcatgttcgaggagatcatcaagaccctgaccgtgttcgaggacagggagatgatcaagaccaggctgagccaccacgaggccaccctgggcaagcacatcatcaagaagctgaccaagaagcactacaccggctggggcaggctgagcaaggagctgatccagggcatcagggacaagcagagcaacaagaccatcctggactacctgatcaacgacgacgacttcccccaccacaggaacaggaacttcatgcagctgatcaacgacgacagcctgagcttcaagaaggagatcaagaaggcccagatgatcaccgacaccgagaacctggaggagatcgtgaaggagctgaccggcagccccgccatcaagaagggcatcctgcagagcctgaagatcgtggacgagatcgtgggcatcatgggctacgagcccgccaacatcgtggtggagatggccagggagaaccagaccaccggcaggggcctgaagagcagcaggcccaggctgaaggccctggaggagagcctgaaggacttcggcagccagctgctgaaggagtaccccaccgacaacagcagcctgcagaaggacaggctgtacctgtactacctgcagaacggcagggacatgtacaccggcgcccccctggacatccacaggctgagcgactacgacatcgaccacatcatccccaggagcttcaccaccgacaacagcatcgacaacaaggtgctggtgagcagcaaggagaacaggctgaagaaggacgacgtgcccagcgagaaggtggtgaagaagatgaggagcttctggtacgacctgtacagcagcaagctgatcagcaagaggaagctggacaacctgaccaagatcaagctgaccgaggaggacaaggccggcttcatcaagaggcagctggtggagaccaggcagatcaccaagcacgtggccggcatcctgcaccacaggttcaacaaggccgaggacaccaacgagcccatcaggaaggtgaggatcatcaccctgaagagcgccctggtgagccagttcaggaacaggttcggcatctacaaggtgagggagatcaacgagtaccaccacgcccacgacgcctacctgaacggcgtgatcgccctggccctgctgaagaagtacccccagctggcccccgagttcgtgtacggcgagtacctgaagttcaacgcccacaaggccaacaaggccaccgtgaagaaggagttctacagcaacatcatgaagttcttcgagagcgacacccccgtgtgcgacgagaacggcgagatcttctgggacaagagcaagagcatcgcccaggtgaagaaggtgatcaaccaccaccacatgaacatcgtgaagaagaccgagatccagaagggcggcttcagcaaggagaccgtggagcccaagaaggacagcagcaagctgctgcccaggaagaacaactgggaccccgccaagtacggcggcctgggcagccccaacgtggcctacaccgtggccttcacctacgagaagggcaaggccaggaagaggaccaacgccctggagggcatcaccatcatggagagggaggccttcgagcagagccccgtgctgttcctgaagaacaagggctacgagcaggccgagatcgagatgaagctgcccaagtacgccctgttcgagctggagaacggcaggaagaggatggtggccagcaacaaggaggcccagaaggccaacagcttcctgctgcccgagcacctggtgaccctgctgtaccacgccaagcagtacgacgagatcagccacaaggagagcttcgactacgtgaacgagcaccacaaggagttcagcgaggtgttcgccagggtgctggagttcgccggcaagtacaccctggccgagaagaacatcgagaagctggagaagatctacaaggagaaccagaccgacgacctggccaagctggccagcagcttcgtgaacctgatgcagttcaacgccatgggcgcccccgccgacttcaagttcttcgacgtgaccatccccaggaagaggtacaccagcctgaccgagatctggcagagcaccatcatccaccagagcatcaccggcctgtacgagaccaggatcaggatgggcaag

SEQ ID NO: 152 - DNA, 3981 bp, synthetic construct
  misc_feature 1..3981: note = source = /note="Description of Artificial Sequence: Syntheticpolynucleotide"
  source 1..3981: mol_type = other DNA
atgaagaagaactacaccatcggcctggacatcggcaccgccagcgtgggctgggccgtgctgaccgaggactacgacctggtgaagaggaagatgaagatcagcggcaacacccagaagaaggccgtgaagaagaacttctggggcgtgaggctgttcgagcagggcgagaccgccgagggcaggaggctgaagaggaccaccaggaggaggatcgccaggaggaggcagaggatccagtacctgaggaccatcttcgacgaggccatgaaccaggtggacgccaacttcttcgccaggctggacgagagcttcagcatcaccgacgagaaggagaacgagaggcaccccatcttcggcaacgtggccgaggaggtggcctaccacgagcagttcaggaccatctacaggctgagggaggtgctggccaacagcagcgagcaggccgacctgaggctgatctacctggccctggcccacatcatcaagttcaggggccacttcctgatcgagggcgagctgaacaccgagaacagcagcgtgagcggcaccttcgagcagttcatcaaggtgtacaacgagaccttcaacgtggagaaggtgctggagctgaccgtggacctggacgagatcgccaagcagaaggtgagcaggatgaagagggccgagctgatcctgagcctgttccccgaggagaagagcaccggcgacttcgcccagttcatcaagatgatcgtgggcaaccagggcaacgtgaagaagaccttcagcctgaacgaggacgccaagatccagttcagcaaggaggagtacgaggagaacctggagaccctgctggccgagatcggcgaggacttcaggggcgtgttcgacgccgccaagagcgtgtacgacgccatcagcctggccaacatcctgaaggtgaccgacgccgccaccagggccaagctgagcagcagcatggtggccaggttcaaggagcacaaggaggacctgaaggccctgaagcagttcgtgagggacaacctgcccgacgagtacgacgacctgttcaagaacaagaaggtggccggctacgccggctacatcgacggcgacgccacccaggaggagttctacaagtacctgaagaaggccctggccaagaccaccggcgccgagtacttcctggccaagatcgagcaggaggacttcctgaggaagcagaggaccttcgacaacggcgtgatcccctaccagctgcacctggaggagctgaaggccatcatcaggaaccagaagccctactaccccttcctggacgaggagaagatcagccagctgatgaccttcaggatcccctactacgtgggccccctggcccagggccagggcaacttcgcctggctgaccaggaaggagagcggcaagatcaccccctggaacctgaacgagaaggtggacatcgagaagagcgccaccgacttcgtggagaggatgaccaacaacgacagctacctgcccatggagaaggtgctgcccaagcacagcctgctgtacgagaagttcaccgtgtacaacgagctgaccaaggtgaggtacatggacgacaacggcagggtgcagaacttcagcagcaaggagaagcagcagatcgtgaacgacctgttcaagcagcagaggaaggtgaagaaggagatcctggaggccttcatcaagaacgagtacggcatcgagaaccccaaggtggagggcatcgagaaggccttcaacgccagcctgggcacctaccacgacctggtgaagctgggcatcaggcccgccctgttcgagcagcccgagtacgagcagcagttcgagcagatcgtgaagatcctgaccgtgttcgaggacaggaagatgaggaggaagcagctggagcagttcagcgacctgctgaccgaggacgagcagaagcagctggagaggaagcactacaagggctggggcaggctgagcgccaagctgatccacggcatcgtggaccagaagacccagaagaccatcctggactacctgatcgacgacgacgacctgcccaggaacaggaacaggaacttcatgcagctgatcaacgacgagaacctgagcttcaaggaggagatcgagaagatcgccttcgacaacgacaagagcaccgaggagatcgtgcaggagctggccggcagccccgccatcaagaagggcatcctgcagagcctgaagatcgtggaggagatcatcgagatcatgggcgagctgcccaccaacatcgtggtggagatggccagggagaaccagaccaccgcccagggcaacagggccagccaggccaggatgaagtacctggaggagagcatcaagaagctgggcagcagcatcctggaggacgagcccatcagcaaggacgccaacctgctgaggaacgacaggctgttcctgtactacctgcagaacggcagggacatgtacaccggcgacgagctggacatcaacaacctgagcagctacgacatcgaccacatcatcccccagagcttcgtgaaggacgacagcatcgacaacagggtgctgaccacccagaggatcaacaggggcaagagcaacaccgtgcccgccgagagcgtggtgaaggacatgagggccacctgggagaggctgtacgccagcaacctgatcagcaagaagaagctgaacaacctgatgaaggccgtgaacggcggcctgaccgaggaggacaaggcctacttcatccagaggcagctggtggagaccaggcagatcaccaagaacgtggcccagatcctgcaccagaagtacaacaacgagcagagcagcgagaagcccgtgagggtggtgaccctgaagagcgccctggccagccagttcaggaaggacttcagcctgtacaagatcagggagctgaacgactaccaccacgcccaggacgcctacctgaacggcgtgatcgcccaggccctgctgaaggtgtaccccaagctggagcccgagttcgtgtacggcgagtaccagaaggtgagcatcagggccctgaacaaggccaccgccaagaaggagacctacagcaacatcatgaagttcttcaccaacgacgaggtgctgaccaacaaggagaccggcgaggtgctgtggaacaggcagagggacatcaagaccatcaagaaggtgatgaactaccaccagatgaacatcgtgaagaaggtggagatccagaccggcaggttcaccaaggagagcatccagcccaagggccccagcaagaagctgatcgccaggaagaacaactgggcccccgtgaactacggcggcttcgacagccccaccgtggcctacagcgtgatcatcacccacgagaagggcaaggccgccaaggtggtgcagcagctggtgggcatcaagatcctggagaggcaggccttcgagcagaacgaggtggccttcctggagggcaagggcttcatccaccccaaggtgcagctgaagctgcccaagtacagcctgtaccagttcgccgacggcaggaggaggctgctggccagcgccgacgaggcccagaagggcaaccagatggtgctgcccaccgagctgatcgagctgctgtaccacgccaagcacgtgaacgacagcagcggcgagagcctgacctacctggagaaccacaggaccaagttcgccgagctgctggaggtgatcctgcagttcaccaacaggtacgtgggcgccgaggacaggcagaagaccgtgagggacctgtacgagaagaaccaggacgccgacatgaaggagctggcccccagcttcgtgcagctgctgcagctgaacaagcagggcgcccccgccagcttcaagttcttcggcgagaccatcgagaggagcaggtacaagaacatgaccgagctgaacaaggccaccttcatcaaccagagcatcaccggcctgtacgagacccagaggaggctggtg

SEQ ID NO: 153 - DNA, 20 bp, synthetic construct
  misc_feature 1..20: note = source = /note="Description of Artificial Sequence: Syntheticoligonucleotide"
  source 1..20: mol_type = other DNA
ggacagtgcgcatctccctg

SEQ ID NO: 154 - DNA, 20 bp, synthetic construct
  misc_feature 1..20: note = source = /note="Description of Artificial Sequence: Syntheticoligonucleotide"
  source 1..20: mol_type = other DNA
cctgaatgctgtgcggctct

SEQ ID NO: 155 - DNA, 20 bp, synthetic construct
  misc_feature 1..20: note = source = /note="Description of Artificial Sequence: Syntheticoligonucleotide"
  source 1..20: mol_type = other DNA
gccgcacagcattcaggtcg

SEQ ID NO: 156 - DNA, 20 bp, synthetic construct
  misc_feature 1..20: note = source = /note="Description of Artificial Sequence: Syntheticoligonucleotide"
  source 1..20: mol_type = other DNA
gggccattaaaacctctcca

SEQ ID NO: 157 - DNA, 20 bp, synthetic construct
  misc_feature 1..20: note = source = /note="Description of Artificial Sequence: Syntheticoligonucleotide"
  source 1..20: mol_type = other DNA
aggttttaatggcccagcct

SEQ ID NO: 158 - DNA, 20 bp, synthetic construct
  misc_feature 1..20: note = source = /note="Description of Artificial Sequence: Syntheticoligonucleotide"
  source 1..20: mol_type = other DNA
catggcagtacattagagca

SEQ ID NO: 159 - DNA, 25 bp, synthetic construct
  misc_feature 1..25: note = source = /note="Description of Artificial Sequence: Syntheticoligonucleotide"
  source 1..25: mol_type = other DNA
agctgtttgggaggtcagaaatagg

SEQ ID NO: 160 - DNA, 25 bp, synthetic construct
  misc_feature 1..25: note = source = /note="Description of Artificial Sequence: Syntheticoligonucleotide"
  source 1..25: mol_type = other DNA
ggctgttctcgcttcggaggagccg

SEQ ID NO: 161 - DNA, 25 bp, synthetic construct
  misc_feature 1..25: note = source = /note="Description of Artificial Sequence: Syntheticoligonucleotide"
  source 1..25: mol_type = other DNA
aaagggggtggggggagtttgctcc

SEQ ID NO: 162 - DNA, 25 bp, synthetic construct
  misc_feature 1..25: note = source = /note="Description of Artificial Sequence: Syntheticoligonucleotide"
  source 1..25: mol_type = other DNA
atccagtgtgtgaagaagcgggacc

SEQ ID NO: 163 - DNA, 25 bp, synthetic construct
  misc_feature 1..25: note = source = /note="Description of Artificial Sequence: Syntheticoligonucleotide"
  source 1..25: mol_type = other DNA
ggacagtgcgcatctccctggtcac

SEQ ID NO: 164 - DNA, 25 bp, synthetic construct
  misc_feature 1..25: note = source = /note="Description of Artificial Sequence: Syntheticoligonucleotide"
  source 1..25: mol_type = other DNA
gctgggccattaaaacctctccagg

SEQ ID NO: 165 - DNA, 25 bp, synthetic construct
  misc_feature 1..25: note = source = /note="Description of Artificial Sequence: Syntheticoligonucleotide"
  source 1..25: mol_type = other DNA
ctcccttgagccctaagagcagatt

SEQ ID NO: 166 - DNA, 25 bp, synthetic construct
  misc_feature 1..25: note = source = /note="Description of Artificial Sequence: Syntheticoligonucleotide"
  source 1..25: mol_type = other DNA
tgtgaggctgggccattaaaacctc

SEQ ID NO: 167 - DNA, 25 bp, synthetic construct
  misc_feature 1..25: note = source = /note="Description of Artificial Sequence: Syntheticoligonucleotide"
  source 1..25: mol_type = other DNA
gtagctgtttgggaggtcagaaata

SEQ ID NO: 168 - DNA, 25 bp, synthetic construct
  misc_feature 1..25: note = source = /note="Description of Artificial Sequence: Syntheticoligonucleotide"
  source 1..25: mol_type = other DNA
ggaaagggggtggggggagtttgct

SEQ ID NO: 169 - DNA, 20 bp, synthetic construct
  misc_feature 1..20: note = source = /note="Description of Artificial Sequence: Syntheticoligonucleotide"
  source 1..20: mol_type = other DNA
cctgaatgctgtgcggctct

SEQ ID NO: 170 - DNA, 25 bp, synthetic construct
  misc_feature 1..25: note = source = /note="Description of Artificial Sequence: Syntheticoligonucleotide"
  source 1..25: mol_type = other DNA
gttttaatggcccagcctcacaccc

SEQ ID NO: 171 - DNA, 25 bp, synthetic construct
  misc_feature 1..25: note = source = /note="Description of Artificial Sequence: Syntheticoligonucleotide"
  source 1..25: mol_type = other DNA
gggccattaaaacctctccaggggc

SEQ ID NO: 172 - DNA, 20 bp, synthetic construct
  misc_feature 1..20: note = source = /note="Description of Artificial Sequence: Syntheticoligonucleotide"
  source 1..20: mol_type = other DNA
cttgtagctggaggtccatc

SEQ ID NO: 173 - DNA, 20 bp, synthetic construct
  misc_feature 1..20: note = source = /note="Description of Artificial Sequence: Syntheticoligonucleotide"
  source 1..20: mol_type = other DNA
tgttggcaaatctagtctcg

SEQ ID NO: 174 - DNA, 19 bp, synthetic construct
  misc_feature 1..19: note = source = /note="Description of Artificial Sequence: Syntheticoligonucleotide"
  source 1..19: mol_type = other DNA
acatttgacgagcagcgaa

SEQ ID NO: 175 - DNA, 20 bp, synthetic construct
  misc_feature 1..20: note = source = /note="Description of Artificial Sequence: Syntheticoligonucleotide"
  source 1..20: mol_type = other DNA
ggcccctggagaggttttaa

SEQ ID NO: 176 - DNA, 20 bp, synthetic construct
  misc_feature 1..20: note = source = /note="Description of Artificial Sequence: Syntheticoligonucleotide"
  source 1..20: mol_type = other DNA
acacagcttcccgttctcag

SEQ ID NO: 177 - DNA, 20 bp, synthetic construct
  misc_feature 1..20: note = source = /note="Description of Artificial Sequence: Syntheticoligonucleotide"
  source 1..20: mol_type = other DNA
attcacccagcttccctgtg

SEQ ID NO: 178 - DNA, 20 bp, synthetic construct
  misc_feature 1..20: note = source = /note="Description of Artificial Sequence: Syntheticoligonucleotide"
  source 1..20: mol_type = other DNA
ggcgtcgcactgaaactttt

SEQ ID NO: 179 - DNA, 20 bp, synthetic construct
  misc_feature 1..20: note = source = /note="Description of Artificial Sequence: Syntheticoligonucleotide"
  source 1..20: mol_type = other DNA
agttcatggtttcggaggcc

SEQ ID NO: 180 - DNA, 20 bp, synthetic construct
  misc_feature 1..20: note = source = /note="Description of Artificial Sequence: Syntheticoligonucleotide"
  source 1..20: mol_type = other DNA
cgaccaaacaagtgcaaagg

SEQ ID NO: 181 - DNA, 20 bp, synthetic construct
  misc_feature 1..20: note = source = /note="Description of Artificial Sequence: Syntheticoligonucleotide"
  source 1..20: mol_type = other DNA
gggttgttgttggtctggat

SEQ ID NO: 182 - DNA, 20 bp, synthetic construct
  misc_feature 1..20: note = source = /note="Description of Artificial Sequence: Syntheticoligonucleotide"
  source 1..20: mol_type = other DNA
actgccatgggaagaaggtg

SEQ ID NO: 183 - DNA, 20 bp, synthetic construct
  misc_feature 1..20: note = source = /note="Description of Artificial Sequence: Syntheticoligonucleotide"
  source 1..20: mol_type = other DNA
acaattctcctgcctcagcc

SEQ ID NO: 184 - DNA, 20 bp, synthetic construct
  misc_feature 1..20: note = source = /note="Description of Artificial Sequence: Syntheticoligonucleotide"
  source 1..20: mol_type = other DNA
tggcccctatgtggagatca

SEQ ID NO: 185 - DNA, 20 bp, synthetic construct
  misc_feature 1..20: note = source = /note="Description of Artificial Sequence: Syntheticoligonucleotide"
  source 1..20: mol_type = other DNA
ggcagagctcagcctcatag

SEQ ID NO: 186 - DNA, 20 bp, synthetic construct
  misc_feature 1..20: note = source = /note="Description of Artificial Sequence: Syntheticoligonucleotide"
  source 1..20: mol_type = other DNA
atatccccacttcccctgct

SEQ ID NO: 187 - DNA, 20 bp, synthetic construct
  misc_feature 1..20: note = source = /note="Description of Artificial Sequence: Syntheticoligonucleotide"
  source 1..20: mol_type = other DNA
cacctcaaggacagctctgg

SEQ ID NO: 188 - RNA, 124 nt, synthetic construct
  misc_feature 1..124: note = source = /note="Description of Artificial Sequence: Syntheticpolynucleotide"
  source 1..124: mol_type = other RNA
ggacagtgcgcatctccctggtcatagttccattaaaaaagtttgatgttcctatgataagggccttgagcccgtggcgttggggatcgcctgcccgtttatacgggcttctccctacttactt

SEQ ID NO: 189 - RNA, 124 nt, synthetic construct
  misc_feature 1..124: note = source = /note="Description of Artificial Sequence: Syntheticpolynucleotide"
  source 1..124: mol_type = other RNA
cctgaatgctgtgcggctctgtcatagttccattaaaaaagtttgatgttcctatgataagggccttgagcccgtggcgttggggatcgcctgcccgtttatacgggcttctccctacttactt

SEQ ID NO: 190 - RNA, 124 nt, synthetic construct
  misc_feature 1..124: note = source = /note="Description of Artificial Sequence: Syntheticpolynucleotide"
  source 1..124: mol_type = other RNA
gccgcacagcattcaggtcggtcatagttccattaaaaaagtttgatgttcctatgataagggccttgagcccgtggcgttggggatcgcctgcccgtttatacgggcttctccctacttactt

SEQ ID NO: 191 - RNA, 124 nt, synthetic construct
  misc_feature 1..124: note = source = /note="Description of Artificial Sequence: Syntheticpolynucleotide"
  source 1..124: mol_type = other RNA
gggccattaaaacctctccagtcatagttccattaaaaaagtttgatgttcctatgataagggccttgagcccgtggcgttggggatcgcctgcccgtttatacgggcttctccctacttactt

SEQ ID NO: 192 - RNA, 124 nt, synthetic construct
  misc_feature 1..124: note = source = /note="Description of Artificial Sequence: Syntheticpolynucleotide"
  source 1..124: mol_type = other RNA
aggttttaatggcccagcctgtcatagttccattaaaaaagtttgatgttcctatgataagggccttgagcccgtggcgttggggatcgcctgcccgtttatacgggcttctccctacttactt

SEQ ID NO: 193 - RNA, 124 nt, synthetic construct
  misc_feature 1..124: note = source = /note="Description of Artificial Sequence: Syntheticpolynucleotide"
  source 1..124: mol_type = other RNA
catggcagtacattagagcagtcatagttccattaaaaaagtttgatgttcctatgataagggccttgagcccgtggcgttggggatcgcctgcccgtttatacgggcttctccctacttactt

SEQ ID NO: 194 - RNA, 129 nt, synthetic construct
  misc_feature 1..129: note = source = /note="Description of Artificial Sequence: Syntheticpolynucleotide"
  source 1..129: mol_type = other RNA
agctgtttgggaggtcagaaatagggtcatagttccattaaaaaagtttgatgttcctatgataagggccttgagcccgtggcgttggggatcgcctgcccgtttatacgggcttctccctacttactt

SEQ ID NO: 195 - RNA, 129 nt, synthetic construct
  misc_feature 1..129: note = source = /note="Description of Artificial Sequence: Syntheticpolynucleotide"
  source 1..129: mol_type = other RNA
aaagggggtggggggagtttgctccgtcatagttccattaaaaaagtttgatgttcctatgataagggccttgagcccgtggcgttggggatcgcctgcccgtttatacgggcttctccctacttactt

SEQ ID NO: 196 - RNA, 168 nt, synthetic construct
  misc_feature 1..168: note = source = /note="Description of Artificial Sequence: Syntheticpolynucleotide"
  source 1..168: mol_type = other RNA
tcacccccacgagcttgtaggaaaggctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 197 - RNA, 168 nt, synthetic construct
  misc_feature 1..168: note = source = /note="Description of Artificial Sequence: Syntheticpolynucleotide"
  source 1..168: mol_type = other RNA
atccagtgtgtgaagaagcgggaccgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 198 - RNA, 168 nt, synthetic construct
  misc_feature 1..168: note = source = /note="Description of Artificial Sequence: Syntheticpolynucleotide"
  source 1..168: mol_type = other RNA
ggacagtgcgcatctccctggtcacgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 199 - RNA, 168 nt, synthetic construct
  misc_feature 1..168: note = source = /note="Description of Artificial Sequence: Syntheticpolynucleotide"
  source 1..168: mol_type = other RNA
gctgggccattaaaacctctccagggctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 200 - RNA, 168 nt, synthetic construct
  misc_feature 1..168: note = source = /note="Description of Artificial Sequence: Syntheticpolynucleotide"
  source 1..168: mol_type = other RNA
ctcccttgagccctaagagcagattgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 201 - RNA, 168 nt, synthetic construct
  misc_feature 1..168: note = source = /note="Description of Artificial Sequence: Syntheticpolynucleotide"
  source 1..168: mol_type = other RNA
tgtgaggctgggccattaaaacctcgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 202 - RNA, 168 nt, synthetic construct
  misc_feature 1..168: note = source = /note="Description of Artificial Sequence: Syntheticpolynucleotide"
  source 1..168: mol_type = other RNA
gtagctgtttgggaggtcagaaatagctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 203 - RNA, 168 nt, synthetic construct
  misc_feature 1..168: note = source = /note="Description of Artificial Sequence: Syntheticpolynucleotide"
  source 1..168: mol_type = other RNA
ggaaagggggtggggggagtttgctgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 204 - RNA, 159 nt, synthetic construct
  misc_feature 1..159: note = source = /note="Description of Artificial Sequence: Syntheticpolynucleotide"
  source 1..159: mol_type = other RNA
gggccattaaaacctctccagccataattcctctgtaaaacttaaagaaggtttatagagttattatggtaaggcaatatgccgtggcgttggggatcgcctatgtccggttttaccggatctccctaaaggtgactaactttggttagtcaccttttt

SEQ ID NO: 205 - RNA, 159 nt, synthetic construct
  misc_feature 1..159: note = source = /note="Description of Artificial Sequence: Syntheticpolynucleotide"
  source 1..159: mol_type = other RNA
aggttttaatggcccagcctgccataattcctctgtaaaacttaaagaaggtttatagagttattatggtaaggcaatatgccgtggcgttggggatcgcctatgtccggttttaccggatctccctaaaggtgactaactttggttagtcaccttttt

SEQ ID NO: 206 - RNA, 159 nt, synthetic construct
  misc_feature 1..159: note = source = /note="Description of Artificial Sequence: Syntheticpolynucleotide"
  source 1..159: mol_type = other RNA
ggacagtgcgcatctccctggccataattcctctgtaaaacttaaagaaggtttatagagttattatggtaaggcaatatgccgtggcgttggggatcgcctatgtccggttttaccggatctccctaaaggtgactaactttggttagtcaccttttt

SEQ ID NO: 207 - RNA, 159 nt, synthetic construct
  misc_feature 1..159: note = source = /note="Description of Artificial Sequence: Syntheticpolynucleotide"
  source 1..159: mol_type = other RNA
cctgaatgctgtgcggctctgccataattcctctgtaaaacttaaagaaggtttatagagttattatggtaaggcaatatgccgtggcgttggggatcgcctatgtccggttttaccggatctccctaaaggtgactaactttggttagtcaccttttt

SEQ ID NO: 208 - RNA, 159 nt, synthetic construct
  misc_feature 1..159: note = source = /note="Description of Artificial Sequence: Syntheticpolynucleotide"
  source 1..159: mol_type = other RNA
gccgcacagcattcaggtcggccataattcctctgtaaaacttaaagaaggtttatagagttattatggtaaggcaatatgccgtggcgttggggatcgcctatgtccggttttaccggatctccctaaaggtgactaactttggttagtcaccttttt

SEQ ID NO: 209 - RNA, 164 nt, synthetic construct
  misc_feature 1..164: note = source = /note="Description of Artificial Sequence: Syntheticpolynucleotide"
  source 1..164: mol_type = other RNA
gttttaatggcccagcctcacacccgccataattcctctgtaaaacttaaagaaggtttatagagttattatggtaaggcaatatgccgtggcgttggggatcgcctatgtccggttttaccggatctccctaaaggtgactaactttggttagtcaccttttt

SEQ ID NO: 210 - RNA, 164 nt, synthetic construct
  misc_feature 1..164: note = source = /note="Description of Artificial Sequence: Syntheticpolynucleotide"
  source 1..164: mol_type = other RNA
gggccattaaaacctctccaggggcgccataattcctctgtaaaacttaaagaaggtttatagagttattatggtaaggcaatatgccgtggcgttggggatcgcctatgtccggttttaccggatctccctaaaggtgactaactttggttagtcaccttttt

SEQ ID NO: 211 - protein, 415 aa, synthetic construct
  REGION 1..415: note = source = /note="Description of Artificial Sequence: Syntheticpolypeptide"
MAKRPAATKKAGQAKKKKSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSS

SEQ ID NO: 212 - protein, 82 aa, synthetic construct
  REGION 1..82: note = source = /note="Description of Artificial Sequence: Syntheticpolypeptide"
TNLSDHEKETGKQLVIQESILMLPEEVEEVIGNKPESDILVHTAYDESTDENVMLLTSDAPEYKPWALVIQDSNGENKIKML

SEQ ID NO: 213 - protein, 1573 aa, synthetic construct
  REGION 1..1573: note = source = /note="Description of Artificial Sequence: Syntheticpolypeptide"
MAPKKKRKVDYKDHDGDYKDHDIDYKDDDDKMAKRPAATKKAGQAKKKKSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSSSGGSSGGSSGSETPGTSESATPESSGGSSGGSMDYRIGLAIGTNSVGWGVIRMQYNDLLERYEKQGIVDAGVRMFDKAEIPKTGASLAAPRREARSSRKRLRRRSQRKKAIRYLIILHELLSEDQLQQLYPLQKESIDIWDIRLESLDRVLNQTEWARLLIHLGQRRGFKSNRKSEYKEEETGKVLVNIQENQKALQQYRTVAEMWMKDAKFSQFDKKRNAPGEYLFSVSRYDLQNEIQTIFESQRNLGSPYATTDLEEEYISVWSKQLPFASGEDILKKVGYCSLERKERRIPKATYTFQYFILLDGLNKIRVGADARQLTTEERSILIEKILTRNDYFSKKSLPDLTYGDLRKWLALDSSLLFKDLTYDPNEKVSKVEKKVFANLKSLYELRKVVETSSNGQSFERIDYDTFGYALTVYKTDEDIRRYLKKPSNLAHKVYEEDLIERLLSLSYEKFGHLSLKAIQTILPYMEDGMMYTEAVQAAGYDITGLQSAKRTLLLPTIPADITNPVVRRALTQTRKVVNAIIKRYGSPLTIHIELARELSKDHQERQQILKNQQANYERNKGAISVLVENGILNPTGYDIVRYKLWKEQGERCAYSLKVIPPSVFFGELKRERNHIPTLEVDAILPYSQSFMDNYHNKVLVYSDENQKKGNRIPSQYLMAVSPEKWTKFEEYVSSNKGFSKQKRQYLLKKDYSSRERDIVKERHLVDTRYATRFMKNFIEKTLLFKESRSSSLTKRVQTVNGKITAHFRKRWGLEKERTETYLHHALDAIVVACTDQHMVTRVTEYYQERERNVRQPYFPWPWEGFRDELLNYLNRQPDSLEISQSIKQNLFLRDYLMVSRMPKHSVTGMSHKQTIRSKACVDEKGKVKTTKRVLLQDIKFDSNGDFKMIGKEQDMATYNAIKERFLSSGGNVKSAFTEPLHKPSKKGKGNVIRKVTVEDQTKSFVRDVNGGVAENGSLVRIDLFEKEGMYYVVPIYVGDTVLKQLPIKISASNRGYYKWVELDENYRFKFSLYAHDLIRIVTKDEDRFFYFSYFDNDGNRIKFLNINSPTGKNENRYGVRSIKLIEKYNVSTLGDISLVKSEERQLFQGMKKKVLNIINSGGSKRPAATKKAGQAKKKK

SEQ ID NO: 214 - protein, 1075 aa, synthetic construct
  REGION 1..1075: note = source = /note="Description of Artificial Sequence: Syntheticpolypeptide"
MDYRIGLAIGTNSVGWGVIRMQYNDLLERYEKQGIVDAGVRMFDKAEIPKTGASLAAPRREARSSRKRLRRRSQRKKAIRYLIILHELLSEDQLQQLYPLQKESIDIWDIRLESLDRVLNQTEWARLLIHLGQRRGFKSNRKSEYKEEETGKVLVNIQENQKALQQYRTVAEMWMKDAKFSQFDKKRNAPGEYLFSVSRYDLQNEIQTIFESQRNLGSPYATTDLEEEYISVWSKQLPFASGEDILKKVGYCSLERKERRIPKATYTFQYFILLDGLNKIRVGADARQLTTEERSILIEKILTRNDYFSKKSLPDLTYGDLRKWLALDSSLLFKDLTYDPNEKVSKVEKKVFANLKSLYELRKVVETSSNGQSFERIDYDTFGYALTVYKTDEDIRRYLKKPSNLAHKVYEEDLIERLLSLSYEKFGHLSLKAIQTILPYMEDGMMYTEAVQAAGYDITGLQSAKRTLLLPTIPADITNPVVRRALTQTRKVVNAIIKRYGSPLTIHIELARELSKDHQERQQILKNQQANYERNKGAISVLVENGILNPTGYDIVRYKLWKEQGERCAYSLKVIPPSVFFGELKRERNHIPTLEVDAILPYSQSFMDNYHNKVLVYSDENQKKGNRIPSQYLMAVSPEKWTKFEEYVSSNKGFSKQKRQYLLKKDYSSRERDIVKERHLVDTRYATRFMKNFIEKTLLFKESRSSSLTKRVQTVNGKITAHFRKRWGLEKERTETYLHHALDAIVVACTDQHMVTRVTEYYQERERNVRQPYFPWPWEGFRDELLNYLNRQPDSLEISQSIKQNLFLRDYLMVSRMPKHSVTGMSHKQTIRSKACVDEKGKVKTTKRVLLQDIKFDSNGDFKMIGKEQDMATYNAIKERFLSSGGNVKSAFTEPLHKPSKKGKGNVIRKVTVEDQTKSFVRDVNGGVAENGSLVRIDLFEKEGMYYVVPIYVGDTVLKQLPIKISASNRGYYKWVELDENYRFKFSLYAHDLIRIVTKDEDRFFYFSYFDNDGNRIKFLNINSPTGKNENRYGVRSIKLIEKYNVSTLGDISLVKSEERQLFQGMKKKVLNIIN

SEQ ID NO: 215 - protein, 1591 aa, synthetic construct
  REGION 1..1591: note = source = /note="Description of Artificial Sequence: Syntheticpolypeptide"
MAPKKKRKVDYKDHDGDYKDHDIDYKDDDDKMAKRPAATKKAGQAKKKKSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSSSGGSSGGSSGSETPGTSESATPESSGGSSGGSMMRYSIGLAIGTTSIGSAVINNDLQRFEHLGVRIFDAAENPKDGSSLSAPRRLARSSRKRLRRRKHRVERTKQILINKGLLTKTQVKNLYNSKNVNLDVWDIRVSGLDRKLFNDEFARVLIHFSKNRGFKSNRKSELKEDDNGAILSAVKENKELMEEKGYRTIAEMLVLDERYEGTKRNKDGDYSHVVSRSDIENEIRLLFQKQREYGHPFAIEENEEAFLAIWSSQRPFATKDDIVKKIGTCTLEPREKRAPKSTYTFERFRALDKLNRLRILSTTTPSRPLTNEERDSILNSLFSKKEVKYKELRKMLKLTDDQRFNEIYYSPDETIEKTENRVFLSSESQYKIKKIIEKTESKNMLSTYCPIDYDTIGYALTVFKDDKDIQHYLQNRYVDSKGKAISNMANREYNLELIEELLGLSFSKFGHLSLKALNNILPYMEEGEPYHIACEMAGYQFSQRLTKEKHRLLPPIPVDEIPNPVVVRALTQVRKVLNSIIKKYGPPSDIYIELAREMGKPFKERKSLEREFNENRQVNEKAKAHISELYRVPNDPRPHDILKFKLWKEQNGICPYSFKPISVDYLFNIGYTEVDAIIPYSRSFDDSNGNKVLVLTNENRNKLNRTPYEWFGHDENRWGDFVSFVRTMKVGKKKKDMLLKKNFDEEQEEQILSRNLNDTRYITRYIKSFIEDNLEFRTEENKKQYVHTVNGGYTSLMRKRWGLNKDRRGNDLHHAVDAAIIAVSLPFKHKVNTYFKRQEIGLSNLSNNKKDIFPEPWRNFIKELEARMIQDPEKMKTALESLELETYGEIFLNKLKPIFVSRMPKHSIKGQIHEETIRRVRGLTEEGFLVTVKKTRLDQIPFDKNGDFPMYGKETDIKTYMAIKQRYLEYGQDKQKAFAIPLRKPSKNPENAPIVRSVKIEGKANRVVMLDDKAAADNASIARTEVFRHKETGEYYVTPVYVADIVSNKIPDRLITLKKPYSEWDRITDEYEYLFSLYNNDLIKIVLPKEKETKKYTGGNHLWQEGFFYFKGVDSSNASIKIIDHLNSFEVRIGIRRLIAFEKYQVNPLGEINKVHGEKRPGELLNEEEIKENRKNISSGGSKRPAATKKAGQAKKKK

SEQ ID NO: 216 - protein, 1092 aa, synthetic construct
  REGION 1..1092: note = source = /note="Description of Artificial Sequence: Syntheticpolypeptide"
MRYSIGLAIGTTSIGSAVINNDLQRFEHLGVRIFDAAENPKDGSSLSAPRRLARSSRKRLRRRKHRVERTKQILINKGLLTKTQVKNLYNSKNVNLDVWDIRVSGLDRKLFNDEFARVLIHFSKNRGFKSNRKSELKEDDNGAILSAVKENKELMEEKGYRTIAEMLVLDERYEGTKRNKDGDYSHVVSRSDIENEIRLLFQKQREYGHPFAIEENEEAFLAIWSSQRPFATKDDIVKKIGTCTLEPREKRAPKSTYTFERFRALDKLNRLRILSTTTPSRPLTNEERDSILNSLFSKKEVKYKELRKMLKLTDDQRFNEIYYSPDETIEKTENRVFLSSESQYKIKKIIEKTESKNMLSTYCPIDYDTIGYALTVFKDDKDIQHYLQNRYVDSKGKAISNMANREYNLELIEELLGLSFSKFGHLSLKALNNILPYMEEGEPYHIACEMAGYQFSQRLTKEKHRLLPPIPVDEIPNPVVVRALTQVRKVLNSIIKKYGPPSDIYIELAREMGKPFKERKSLEREFNENRQVNEKAKAHISELYRVPNDPRPHDILKFKLWKEQNGICPYSFKPISVDYLFNIGYTEVDAIIPYSRSFDDSNGNKVLVLTNENRNKLNRTPYEWFGHDENRWGDFVSFVRTMKVGKKKKDMLLKKNFDEEQEEQILSRNLNDTRYITRYIKSFIEDNLEFRTEENKKQYVHTVNGGYTSLMRKRWGLNKDRRGNDLHHAVDAAIIAVSLPFKHKVNTYFKRQEIGLSNLSNNKKDIFPEPWRNFIKELEARMIQDPEKMKTALESLELETYGEIFLNKLKPIFVSRMPKHSIKGQIHEETIRRVRGLTEEGFLVTVKKTRLDQIPFDKNGDFPMYGKETDIKTYMAIKQRYLEYGQDKQKAFAIPLRKPSKNPENAPIVRSVKIEGKANRVVMLDDKAAADNASIARTEVFRHKETGEYYVTPVYVADIVSNKIPDRLITLKKPYSEWDRITDEYEYLFSLYNNDLIKIVLPKEKETKKYTGGNHLWQEGFFYFKGVDSSNASIKIIDHLNSFEVRIGIRRLIAFEKYQVNPLGEINKVHGEKRPGELLNEEEIKENRKNIS

SEQ ID NO: 217 - DNA, 129 bp, synthetic construct
  misc_feature 1..129: note = source = /note="Description of Artificial Sequence: Syntheticpolynucleotide"
  source 1..129: mol_type = other DNA
tgatcctcttgtcccacagatatccgtcatagttccattaaaaaagtttgatgttcctatgataagggccttgagcccgtggcgttggggatcgcctgcccgtttatacgggcttctccctacttactt

SEQ ID NO: 218 - DNA, 164 bp, synthetic construct
  misc_feature 1..164: note = source = /note="Description of Artificial Sequence: Syntheticpolynucleotide"
  source 1..164: mol_type = other DNA
tgatcctcttgtcccacagatatccgccataattcctctgtaaaacttaaagaaggtttatagagttattatggtaaggcaatatgccgtggcgttggggatcgcctatgtccggttttaccggatctccctagaggtgactaactttggttagtcgccttttt

SEQ ID NO: 219 - DNA, 15 bp, synthetic construct
  misc_feature 1..15: note = source = /note="Description of Artificial Sequence: Syntheticprimer"
  source 1..15: mol_type = other DNA
gactccttcaccaag

SEQ ID NO: 220 - DNA, 14 bp, synthetic construct
  misc_feature 1..14: note = source = /note="Description of Artificial Sequence: Syntheticprimer"
  source 1..14: mol_type = other DNA
gtagatcagcaccg

SEQ ID NO: 221 - DNA, 14 bp, synthetic construct
  misc_feature 1..14: note = source = /note="Description of Artificial Sequence: Syntheticprobe"
  source 1..14: mol_type = other DNA
ctctgggccgaagt

SEQ ID NO: 222 - DNA, 14 bp, synthetic construct
  misc_feature 1..14: note = source = /note="Description of Artificial Sequence: Syntheticprobe"
  source 1..14: mol_type = other DNA
ctctaggccgaagt

SEQ ID NO: 223 - DNA, 13 bp, synthetic construct
  misc_feature 1..13: note = source = /note="Description of Artificial Sequence: Syntheticoligonucleotide"
  source 1..13: mol_type = other DNA
acttcctccagcc

SEQ ID NO: 224 - DNA, 13 bp, synthetic construct
  misc_feature 1..13: note = source = /note="Description of Artificial Sequence: Syntheticoligonucleotide"
  source 1..13: mol_type = other DNA
gaaccccggctta

SEQ ID NO: 225 - DNA, 31 bp, synthetic construct
  misc_feature 1..31: note = source = /note="Description of Artificial Sequence: Syntheticoligonucleotide"
  source 1..31: mol_type = other DNA
ggagcagctctaggccgaagtgtcgcaggcc

SEQ ID NO: 226 - DNA, 31 bp, synthetic construct
  misc_feature 1..31: note = source = /note="Description of Artificial Sequence: Syntheticoligonucleotide"
  source 1..31: mol_type = other DNA
agaacaactctaggcagaggtctcaaaggct

SEQ ID NO: 227 - DNA, 31 bp, synthetic construct; identical to SEQ ID NO: 225
  misc_feature 1..31: note = source = /note="Description of Artificial Sequence: Syntheticoligonucleotide"
  source 1..31: mol_type = other DNA

SEQ ID NO: 228 - DNA, 25 bp, synthetic construct
  misc_feature 1..25: note = source = /note="Description of Artificial Sequence: Syntheticoligonucleotide"
  source 1..25: mol_type = other DNA
acctgaggtccggagttcaagacta

SEQ ID NO: 229 - RNA, 168 nt, synthetic construct
  misc_feature 1..168: note = source = /note="Description of Artificial Sequence: Syntheticpolynucleotide"
  source 1..168: mol_type = other RNA
acctgaggtccggagttcaagactagctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 230 - DNA, 25 bp, synthetic construct
  misc_feature 1..25: note = source = /note="Description of Artificial Sequence: Syntheticoligonucleotide"
  source 1..25: mol_type = other DNA
aggtggatcacctgaggtccggagt

SEQ ID NO: 231 - RNA, 168 nt, synthetic construct
  misc_feature 1..168: note = source = /note="Description of Artificial Sequence: Syntheticpolynucleotide"
  source 1..168: mol_type = other RNA
aggtggatcacctgaggtccggagtgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 232 - DNA, 25 bp, synthetic construct
  misc_feature 1..25: note = source = /note="Description of Artificial Sequence: Syntheticoligonucleotide"
  source 1..25: mol_type = other DNA
gggcgtggtgtcgcgcgcctgtaat

SEQ ID NO: 233 - RNA, 168 nt, synthetic construct
  misc_feature 1..168: note = source = /note="Description of Artificial Sequence: Syntheticpolynucleotide"
  source 1..168: mol_type = other RNA
gggcgtggtgtcgcgcgcctgtaatgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 234 - DNA, 25 bp, synthetic construct
  misc_feature 1..25: note = source = /note="Description of Artificial Sequence: Syntheticoligonucleotide"
  source 1..25: mol_type = other DNA
aagttagccgggcgtggtgtcgcgc

SEQ ID NO: 235 - RNA, 168 nt, synthetic construct
  misc_feature 1..168: note = source = /note="Description of Artificial Sequence: Syntheticpolynucleotide"
  source 1..168: mol_type = other RNA
aagttagccgggcgtggtgtcgcgcgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 236 - DNA, 500 bp, synthetic construct
  misc_feature 1..500: note = source = /note="Description of Artificial Sequence: Syntheticpolynucleotide"
  source 1..500: mol_type = other DNA
aaaaatggacaattatgaggaggggagagtgcagacaggggaagcttcacctcctttacaattttgggagtccacacggcatggcatacaaattatttcattcccattgagaaataaaatccaattctccatcaccaagagagccttccgaaagaggcccccctgggcaaacggccaccgatggagaggtctgccagtcctcttctaccccacccacgcccccaccctaatcagaggccaaacccttcctggagcctgtgataaaagcaactgttagcttgcactagactagcttcaaagttgtattgaccctggtgtgttatgtctaagagtagatgccatatctcttttctggcctatgttattacctgtatggactttgcactggaatcagctatctgctcttacttatgcacacctggggcatagagccagccctgtatcgcttttcagccatctcactacagataactcccaagtcctgtctagctgccttcctt

SEQ ID NO: 237 - DNA, 25 bp, synthetic construct
  misc_feature 1..25: note = source = /note="Description of Artificial Sequence: Syntheticoligonucleotide"
  source 1..25: mol_type = other DNA
agtgcaagctaacagttgcttttat

SEQ ID NO: 238 - RNA, 168 nt, synthetic construct
  misc_feature 1..168: note = source = /note="Description of Artificial Sequence: Syntheticpolynucleotide"
  source 1..168: mol_type = other RNA
agtgcaagctaacagttgcttttatgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 239 - DNA, 25 bp, synthetic construct
  misc_feature 1..25: note = source = /note="Description of Artificial Sequence: Syntheticoligonucleotide"
  source 1..25: mol_type = other DNA
acaccagggtcaatacaactttgaa

SEQ ID NO: 240 - RNA, 168 nt, synthetic construct
  misc_feature 1..168: note = source = /note="Description of Artificial Sequence: Syntheticpolynucleotide"
  source 1..168: mol_type = other RNA
acaccagggtcaatacaactttgaagctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 241 - DNA, 25 bp, synthetic construct
  misc_feature 1..25: note = source = /note="Description of Artificial Sequence: Syntheticoligonucleotide"
  source 1..25: mol_type = other DNA
gtgataaaagcaactgttagcttgc

SEQ ID NO: 242 - RNA, 168 nt, synthetic construct
  misc_feature 1..168: note = source = /note="Description of Artificial Sequence: Syntheticpolynucleotide"
  source 1..168: mol_type = other RNA
gtgataaaagcaactgttagcttgcgctatagttccataagaaaaaagtttcttaagttactatagtaagggcaatgacccgtggcgtttggggatcgccttatcctggtatggatattctccccatgtgaaaagcacctaagcatagcgctatggtgcttttatttt

SEQ ID NO: 243 - DNA, 25 bp, synthetic construct
  misc_feature 1..25: note = source = /note="Description of Artificial Sequence: Syntheticoligonucleotide"
  source 1..25: mol_type = other DNA
gcactagactagcttcaaagttgta

SEQ ID NO: 244 - RNA, 164 nt, synthetic construct
  misc_feature 1..164: note = source = /note="Description of Artificial Sequence: Syntheticpolynucleotide"
  source 1..164: mol_type = other RNA
gcactagactagcttcaaagttgtagccataattcctctgtaaaacttaaagaaggtttatagagttattatggtaaggcaatatgccgtggcgttggggatcgcctatgtccggttttaccggatctccctagaggtgactaactttggttagtcgccttttt

SEQ ID NO: 245 - DNA, 25 bp, synthetic construct
  misc_feature 1..25: note = source = /note="Description of Artificial Sequence: Syntheticoligonucleotide"
  source 1..25: mol_type = other DNA
ttttatcacaggctccaggaagggt

SEQ ID NO: 246 - RNA, 164 nt, synthetic construct
  misc_feature 1..164: note = source = /note="Description of Artificial Sequence: Syntheticpolynucleotide"
  source 1..164: mol_type = other RNA
ttttatcacaggctccaggaagggtgccataattcctctgtaaaacttaaagaaggtttatagagttattatggtaaggcaatatgccgtggcgttggggatcgcctatgtccggttttaccggatctccctagaggtgactaactttggttagtcgccttttt

SEQ ID NO: 247 - DNA, 25 bp, synthetic construct
  misc_feature 1..25: note = source = /note="Description of Artificial Sequence: Syntheticoligonucleotide"
  source 1..25: mol_type = other DNA
gaagctagtctagtgcaagctaaca

SEQ ID NO: 248 - RNA, 139 nt, synthetic construct
  misc_feature 1..139: note = source = /note="Description of Artificial Sequence: Syntheticpolynucleotide"
  source 1..139: mol_type = other RNA
gccataattcctctgtaaaacttaaagaaggtttatagagttattatggtaaggcaatatgccgtggcgttggggatcgcctatgtccggttttaccggatctccctagaggtgactaactttggttagtcgccttttt

SEQ ID NO: 249 - skipped

SEQ ID NO: 250 - DNA, 13 bp, synthetic construct
  misc_feature 1..13: note = source = /note="Description of Artificial Sequence: Syntheticoligonucleotide"
  source 1..13: mol_type = other DNA
gccgccrccatgg

SEQ ID NO: 251 - protein, 7 aa, synthetic construct
  REGION 1..7: note = source = /note="Description of Artificial Sequence: Syntheticpeptide"
PKKKRKV

SEQ ID NO: 252 - protein, 22 aa, synthetic construct
  REGION 1..22: note = source = /note="Description of Artificial Sequence: Syntheticpeptide"
DYKDHDGDYKDHDIDYKDDDDK

SEQ ID NO: 253 - protein, 16 aa, synthetic construct
  REGION 1..16: note = source = /note="Description of Artificial Sequence: Syntheticpeptide"
KRPAATKKAGQAKKKK

SEQ ID NO: 254 - DNA, 38 bp, synthetic construct
  source 1..38: mol_type = other DNA
  variation 31..38: note = Can be any sequence
gagcggacagcagcttcctatatctcgtacnnnnnnnn

SEQ ID NO: 255 - DNA, 38 bp, synthetic construct
  source 1..38: mol_type = other DNA
  variation 31..38: note = Can be any sequence
ccatgatatagacgttgtggctgttgtagtnnnnnnnn

SEQ ID NO: 256-257 - skipped (2 entries)

SEQ ID NO: 258 - DNA, 203 bp, synthetic construct
  misc_feature 1..203: note = source = /note="Description of Artificial Sequence: Syntheticpolynucleotide"
  source 1..203: mol_type = other DNA
tgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 259 - DNA, 304 bp, synthetic construct
  misc_feature 1..304: note = source = /note="Description of Artificial Sequence: Syntheticpolynucleotide"
  source 1..304: mol_type = other DNA
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatg

SEQ ID NO: 260 - DNA, 318 bp, Homo sapiens
  source 1..318: mol_type = other DNA
tgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacc

SEQ ID NO: 261 - DNA, 25 bp, Homo sapiens
  source 1..25: mol_type = genomic DNA
acctctccagggcgaactctgacac

SEQ ID NO: 262 - DNA, 25 bp, Homo sapiens
  source 1..25: mol_type = genomic DNA
gggaagtaggactgttggaaacggg

SEQ ID NO: 263 - DNA, 25 bp, Homo sapiens
  source 1..25: mol_type = genomic DNA
cccaggaggaggtccagctggagat

SEQ ID NO: 264 - DNA, 25 bp, Homo sapiens
  source 1..25: mol_type = genomic DNA
gagctgctcacaggacgagaacatc

SEQ ID NO: 265 - DNA, 25 bp, Homo sapiens
  source 1..25: mol_type = genomic DNA
gtgtcagagttcgccctggagaggt

SEQ ID NO: 266 - DNA, 25 bp, Homo sapiens
  source 1..25: mol_type = genomic DNA
gtcagagttcgccctggagaggtgg

SEQ ID NO: 267 - DNA, 25 bp, Homo sapiens
  source 1..25: mol_type = genomic DNA
agcagtggacaggctgtgtgtcaga

SEQ ID NO: 268 - DNA, 20 bp, Homo sapiens
  source 1..20: mol_type = genomic DNA
ttatccaggcacctccagcc

SEQ ID NO: 269 - DNA, 20 bp, Homo sapiens
  source 1..20: mol_type = genomic DNA
ctgtgtgtcagagttcgccc

SEQ ID NO: 270 - DNA, 25 bp, Homo sapiens
  source 1..25: mol_type = genomic DNA
ggtggctgagcccagcccggccccc

SEQ ID NO: 271 - DNA, 25 bp, Homo sapiens
  source 1..25: mol_type = genomic DNA
atgcccccgaagcccctctccaccg

SEQ ID NO: 272 - DNA, 25 bp, Homo sapiens
  source 1..25: mol_type = genomic DNA
aagcccctctccaccgcaaaagctg

SEQ ID NO: 273 - DNA, 25 bp, Homo sapiens
  source 1..25: mol_type = genomic DNA
gggcatgcatgaccttggcgtgggc

SEQ ID NO: 274 - DNA, 25 bp, Homo sapiens
  source 1..25: mol_type = genomic DNA
gatcctcaccgagcgcggctacagc

SEQ ID NO: 275 - DNA, 25 bp, Homo sapiens
  source 1..25: mol_type = genomic DNA
gaagagcggcattcaccgtactgtc

SEQ ID NO: 276 - DNA, 25 bp, Homo sapiens
  source 1..25: mol_type = genomic DNA
gcggtacagtccgcacctgctggcc

SEQ ID NO: 277 - DNA, 25 bp, Homo sapiens
  source 1..25: mol_type = genomic DNA
cctgtggcagagttccctgaagcca

SEQ ID NO: 278 - DNA, 25 bp, Homo sapiens
  source 1..25: mol_type = genomic DNA
cagtcacggagcggttggccttcac

SEQ ID NO: 279 - DNA, 25 bp, Homo sapiens
  source 1..25: mol_type = genomic DNA
gacaacaagatgccccctgaggcct

SEQ ID NO: 280 - DNA, 25 bp, Homo sapiens
  source 1..25: mol_type = genomic DNA
gacaacgagatgccccctgaggcct

SEQ ID NO: 281 - DNA, 25 bp, Homo sapiens
  source 1..25: mol_type = genomic DNA
cacacactctgcaccttgaaggctg

SEQ ID NO: 282 - DNA, 25 bp, Homo sapiens
  source 1..25: mol_type = genomic DNA
catcccgtactcccacgaccagata

SEQ ID NO: 283 - DNA, 25 bp, Homo sapiens
  source 1..25: mol_type = genomic DNA
gccctggatgggctcagcggccatg

SEQ ID NO: 284 - DNA, 25 bp, Homo sapiens
  source 1..25: mol_type = genomic DNA
agctgcttttccggggtttccgctg

SEQ ID NO: 285 - DNA, 25 bp, Homo sapiens
  source 1..25: mol_type = genomic DNA
gtggaacttctgtactacaacgctg

SEQ ID NO: 286 - DNA, 25 bp, Homo sapiens
  source 1..25: mol_type = genomic DNA
cccttgaggacctgtgaaatccaga

SEQ ID NO: 287 - DNA, 25 bp, Homo sapiens
  source 1..25: mol_type = genomic DNA
gacctgagagtgggtgttggacagt

SEQ ID NO: 288 - DNA, 25 bp, Homo sapiens
  source 1..25: mol_type = genomic DNA
gctgagtttgtgtgtgaatggacac

SEQ ID NO: 289 - DNA, 25 bp, Homo sapiens
  source 1..25: mol_type = genomic DNA
gcttagggttaccgaagaggggcca

SEQ ID NO: 290 - DNA, 25 bp, Homo sapiens
  source 1..25: mol_type = genomic DNA
gctcagggttactgaagaggggcca

SEQ ID NO: 291 - DNA, 25 bp, Homo sapiens
  source 1..25: mol_type = genomic DNA
tagacagaggacaatggcttccatg

SEQ ID NO: 292 - DNA, 25 bp, Homo sapiens
  source 1..25: mol_type = genomic DNA
tttgcttaagatatcagtgtttggc

SEQ ID NO: 293 - DNA, 25 bp, Homo sapiens
  source 1..25: mol_type = genomic DNA
gatggaagggtagctgttagaaggc

SEQ ID NO: 294 - DNA, 25 bp, Homo sapiens
  source 1..25: mol_type = genomic DNA
atgatggaagggtagctgttagaag

SEQ ID NO: 295 - DNA, 20 bp, Homo sapiens
  source 1..20: mol_type = genomic DNA
gatgtgctttgttctggatt

SEQ ID NO: 296 - DNA, 20 bp, Homo sapiens
  source 1..20: mol_type = genomic DNA
tatgatggaagggtagctgt

SEQ ID NO: 297 - DNA, 20 bp, Homo sapiens
  source 1..20: mol_type = genomic DNA
tgtgcagccagatgcctaga

SEQ ID NO: 298 - DNA, 20 bp, Homo sapiens
  source 1..20: mol_type = genomic DNA
ccttttaaggacactaaaat

SEQ ID NO: 299 - DNA, 25 bp, Homo sapiens
  source 1..25: mol_type = genomic DNA
cagccatgggagccccttcacttca

SEQ ID NO: 300 - DNA, 25 bp, Homo sapiens
  source 1..25: mol_type = genomic DNA
agcaacctccagtggtgaccagaat

SEQ ID NO: 301 - DNA, 25 bp, Homo sapiens
  source 1..25: mol_type = genomic DNA
gttggctgatggtggatggctcata

SEQ ID NO: 302 - DNA, 25 bp, Homo sapiens
  source 1..25: mol_type = genomic DNA
gttggctgatggtggatggctcata

SEQ ID NO: 303 - DNA, 25 bp, Homo sapiens
  source 1..25: mol_type = genomic DNA
tctggtcaccactggaggttgcttg

SEQ ID NO: 304 - DNA, 25 bp, Homo sapiens
  source 1..25: mol_type = genomic DNA
tatgaggcttaataatgtcctcatt

SEQ ID NO: 305 - DNA, 25 bp, Homo sapiens
  source 1..25: mol_type = genomic DNA
atatgaggcttaataatgtcctcat

SEQ ID NO: 306 - DNA, 20 bp, Homo sapiens
  source 1..20: mol_type = genomic DNA
tcaccactggaggttgcttg

SEQ ID NO: 307 - DNA, 20 bp, Homo sapiens
  source 1..20: mol_type = genomic DNA
aaatctccagcaaataaagt

SEQ ID NO: 308 - DNA, 20 bp, Homo sapiens
  source 1..20: mol_type = genomic DNA
ggacagaagattattcttca

SEQ ID NO: 309 - DNA, 25 bp, Homo sapiens
  source 1..25: mol_type = genomic DNA
gccctgatgcagaagaaccggcgga

SEQ ID NO: 310 - DNA, 25 bp, Homo sapiens
  source 1..25: mol_type = genomic DNA
ctctgcagatcactggggtggatcc

SEQ ID NO: 311 - DNA, 25 bp, Homo sapiens
  source 1..25: mol_type = genomic DNA
gcagatcattggggtggatcccgaa

SEQ ID NO: 312 - DNA, 25 bp, Homo sapiens
  source 1..25: mol_type = genomic DNA
ggtggaagggatcggctacgacttc

SEQ ID NO: 313 - DNA, 25 bp, Homo sapiens
  source 1..25: mol_type = genomic DNA
actccaaaggctttcctccactgtt

SEQ ID NO: 314 - DNA, 25 bp, Homo sapiens
  source 1..25: mol_type = genomic DNA
gacttcatccaggtatgtaaaaata

SEQ ID NO: 315 - DNA, 25 bp, Homo sapiens
  source 1..25: mol_type = genomic DNA
atcacactgagtggagatcaacgag

SEQ ID NO: 316 - DNA, 25 bp, Homo sapiens
  source 1..25: mol_type = genomic DNA
cactgagtggagatcaacgagcaag

SEQ ID NO: 317 - DNA, 25 bp, Homo sapiens
  source 1..25: mol_type = genomic DNA
aggtggaatcacactgagtggagat

SEQ ID NO: 318 - DNA, 20 bp, Homo sapiens
  source 1..20: mol_type = genomic DNA
cacactgagtggagatcaac

SEQ ID NO: 319 - DNA, 25 bp, Homo sapiens
  source 1..25: mol_type = genomic DNA
ccccttttgtaggaagtcaccaaag

SEQ ID NO: 320 - DNA, 25 bp, Homo sapiens
  source 1..25: mol_type = genomic DNA
tgacccggataacaaggaggaacac

SEQ ID NO: 321 - DNA, 25 bp, Homo sapiens
  source 1..25: mol_type = genomic DNA
acccggataacaaggaggaacactc

SEQ ID NO: 322 - DNA, 20 bp, Homo sapiens
  source 1..20: mol_type = genomic DNA
ctctatcgcgatttatctag

SEQ ID NO: 323 - DNA, 20 bp, Homo sapiens
  source 1..20: mol_type = genomic DNA
ctgagtggagatcaacgagc

SEQ ID NO: 324 - DNA, 25 bp, Homo sapiens
  source 1..25: mol_type = genomic DNA
gagaggattctttgcagccacgttc

SEQ ID NO: 325 - DNA, 25 bp, Homo sapiens
  source 1..25: mol_type = genomic DNA
ggtgctcgaggattgcccggaacag

SEQ ID NO: 326 - DNA, 25 bp, Homo sapiens
  source 1..25: mol_type = genomic DNA
gctcgaggattgcccggaacagctg

SEQ ID NO: 327 - DNA, 25 bp, Homo sapiens
  source 1..25: mol_type = genomic DNA
ggcctatgggtccccctggtttcgg

SEQ ID NO: 328 - DNA, 25 bp, Homo sapiens
  source 1..25: mol_type = genomic DNA
acagcccagcctacctacccaaaat

SEQ ID NO: 329 - DNA, 25 bp, Homo sapiens
  source 1..25: mol_type = genomic DNA
attttgggtaggtaggctgggctgt

SEQ ID NO: 330 - DNA, 25 bp, Homo sapiens
  source 1..25: mol_type = genomic DNA
cctacccaaaatgtagcttgtatgt

SEQ ID NO: 331 - DNA, 25 bp, Homo sapiens
  source 1..25: mol_type = genomic DNA
tttgtccagagcaaccagctgctca

SEQ ID NO: 332 - DNA, 20 bp, Homo sapiens
  source 1..20: mol_type = genomic DNA
ctacctacccaaaatgtagc

SEQ ID NO: 333 - DNA, 20 bp, Homo sapiens
  source 1..20: mol_type = genomic DNA
acttttcattatggagggct

SEQ ID NO: 334 - DNA, 25 bp, Homo sapiens
  source 1..25: mol_type = genomic DNA
ggacactgcctattttgcggtgagt

SEQ ID NO: 335 - DNA, 25 bp, Homo sapiens
  source 1..25: mol_type = genomic DNA
gctcctcacgcacctgctctggttt

SEQ ID NO: 336 - DNA, 25 bp, Homo sapiens
  source 1..25: mol_type = genomic DNA
tgggccaagactccacctatatcga

SEQ ID NO: 337 - DNA, 25 bp, Homo sapiens
  source 1..25: mol_type = genomic DNA
gttcttcaatgggcgccccgggatc

SEQ ID NO: 338 - DNA, 25 bp, Homo sapiens
  source 1..25: mol_type = genomic DNA
tcagatcaatggcctgcaagcctag

SEQ ID NO: 339 - DNA, 25 bp, Homo sapiens
  source 1..25: mol_type = genomic DNA
atcaatggcctgcaagcctagctcc

SEQ ID NO: 340 - DNA, 20 bp, Homo sapiens
  source 1..20: mol_type = genomic DNA
gcctgcaagcctagctcctc

SEQ ID NO: 341 - DNA, 25 bp, Homo sapiens
  source 1..25: mol_type = genomic DNA
ggcgcttacttgtccaaccacttcc

SEQ ID NO: 342 - DNA, 25 bp, Homo sapiens
  source 1..25: mol_type = genomic DNA
tattcaccggcccgctgatggtccc

SEQ ID NO: 343 - DNA, 25 bp, Homo sapiens
  source 1..25: mol_type = genomic DNA
gatattcaccggcccgctgatggtc

SEQ ID NO: 344 - DNA, 25 bp, Homo sapiens
  source 1..25: mol_type = genomic DNA
tcagaaaaactggctcgagagctcc

SEQ ID NO: 345 - DNA, 25 bp, Homo sapiens
  source 1..25: mol_type = genomic DNA
gtaagtgatccatcctaggttggca

SEQ ID NO: 346 - DNA, 25 bp, Homo sapiens
  source 1..25: mol_type = genomic DNA
cagaacatccttgggggctacaggt

SEQ ID NO: 347 - DNA, 25 bp, Homo sapiens
  source 1..25: mol_type = genomic DNA
gtgcagacattgacgaatgccgcat

SEQ ID NO: 348 - DNA, 25 bp, Homo sapiens
  source 1..25: mol_type = genomic DNA
gacattgacgaatgccgcatatctc

SEQ ID NO: 349 - DNA, 25 bp, Homo sapiens
  source 1..25: mol_type = genomic DNA
gctttgtcatcgacatttataccgg

SEQ ID NO: 350 - DNA, 25 bp, Homo sapiens
  source 1..25: mol_type = genomic DNA
agtgctccccgcaccggcccatcct

SEQ ID NO: 351 - DNA, 20 bp, Homo sapiens
  source 1..20: mol_type = genomic DNA
cagtatggacactgtccaaa

SEQ ID NO: 352 - DNA, 25 bp, Homo sapiens
  source 1..25: mol_type = genomic DNA
ggccctcaccctgcgctacgcactc

SEQ ID NO: 353 - DNA, 25 bp, Homo sapiens
  source 1..25: mol_type = genomic DNA
ttctaacccccacccccactgccgg

SEQ ID NO: 354 - DNA, 25 bp, Homo sapiens
  source 1..25: mol_type = genomic DNA
gagtatcacgtgatccggcacgcca

SEQ ID NO: 355 - DNA, 25 bp, Homo sapiens
  source 1..25: mol_type = genomic DNA
gcagcatcttcttccgggtcatctt

SEQ ID NO: 356 - DNA, 25 bp, Homo sapiens
  source 1..25: mol_type = genomic DNA
gccactgggagcgctggcgtggaca

SEQ ID NO: 357 - DNA, 25 bp, Homo sapiens
  source 1..25: mol_type = genomic DNA
gccagcgctcctagtggccatgcac

SEQ ID NO: 358 - DNA, 25 bp, Homo sapiens
  source 1..25: mol_type = genomic DNA
gcgctcctagtggccatgcacgtgg

SEQ ID NO: 359 - DNA, 25 bp, Homo sapiens
  source 1..25: mol_type = genomic DNA
gcgctcctagtggccatgcacgtgg

SEQ ID NO: 360 - DNA, 25 bp, Homo sapiens
  source 1..25: mol_type = genomic DNA
caccagcattggaaagatctagctc

SEQ ID NO: 361 - DNA, 25 bp, Homo sapiens
  source 1..25: mol_type = genomic DNA
ccaccagcattggaaagatctagct

SEQ ID NO: 362 - DNA, 20 bp, Homo sapiens
  source 1..20: mol_type = genomic DNA
caaaccgcccagagtagaag

SEQ ID NO: 363 - DNA, 20 bp, Homo sapiens
  source 1..20: mol_type = genomic DNA
tggccatgcacgtggcctac

SEQ ID NO: 364 - DNA, 25 bp, Homo sapiens
  source 1..25: mol_type = genomic DNA
tgctgccagcacggttctggactac

SEQ ID NO: 365 - DNA, 25 bp, Homo sapiens
  source 1..25: mol_type = genomic DNA
acggttctggactacacaacacgca

SEQ ID NO: 366 - DNA, 25 bp, Homo sapiens
  source 1..25: mol_type = genomic DNA
ggtgcatctgactcctgaggagaag

SEQ ID NO: 367 - DNA, 25 bp, Homo sapiens
  source 1..25: mol_type = genomic DNA
ccgcagatgaggagcagctctaggc

SEQ ID NO: 368 - DNA, 25 bp, Homo sapiens
  source 1..25: mol_type = genomic DNA
tacgtcctcagctgggactagcagc

SEQ ID NO: 369 - DNA, 25 bp, Homo sapiens
  source 1..25: mol_type = genomic DNA
ggagcagctctgggccgaagtgtcg

SEQ ID NO: 370 - DNA, 25 bp, Homo sapiens
  source 1..25: mol_type = genomic DNA
gatgctacacgtcgaccgccaggga

SEQ ID NO: 371 - DNA, 25 bp, Homo sapiens
  source 1..25: mol_type = genomic DNA
gagctgataaccaccctgtacatcg

SEQ ID NO: 372 - DNA, 25 bp, Homo sapiens
  source 1..25: mol_type = genomic DNA
gatccaccatgatggcccttggctt

SEQ ID NO: 373 - DNA, 25 bp, Homo sapiens
  source 1..25: mol_type = genomic DNA
gcgaagatggcttggatgagtggcc

SEQ ID NO: 374 - DNA, 25 bp, Homo sapiens
  source 1..25: mol_type = genomic DNA
agcatcgatgtcaacgagggcaacc

SEQ ID NO: 375 - DNA, 25 bp, Homo sapiens
  source 1..25: mol_type = genomic DNA
cggaacctgtgaggaggttggcact

SEQ ID NO: 376 - DNA, 25 bp, Homo sapiens
  source 1..25: mol_type = genomic DNA
taggcgatggagcctgggggttcgg

SEQ ID NO: 377 - DNA, 25 bp, Homo sapiens
  source 1..25: mol_type = genomic DNA
gactggggaactcccgacaagatca

SEQ ID NO: 378 - DNA, 25 bp, Homo sapiens
  source 1..25: mol_type = genomic DNA
cggaacctgtgaggaggttggcact

SEQ ID NO: 379 - DNA, 25 bp, Homo sapiens
  source 1..25: mol_type = genomic DNA
tcccgacaagatcaagaaagggggc

SEQ ID NO: 380 - DNA, 25 bp, Homo sapiens
  source 1..25: mol_type = genomic DNA
gacagtagcccctgctcggccttcg

SEQ ID NO: 381 - DNA, 25 bp, Homo sapiens
  source 1..25: mol_type = genomic DNA
ggaactcccgccaagatcaagaaag

SEQ ID NO: 382 - DNA, 25 bp, Homo sapiens
  source 1..25: mol_type = genomic DNA
gcggctgccagtatctgtgcctccc

SEQ ID NO: 383 - DNA, 25 bp, Homo sapiens
  source 1..25: mol_type = genomic DNA
gaatgatctgcaggtgagcgtcgcc

SEQ ID NO: 384 - DNA, 25 bp, Homo sapiens
  source 1..25: mol_type = genomic DNA
ggctacaagtgccagtgtgaggaag

SEQ ID NO: 385 - DNA, 25 bp, Homo sapiens
  source 1..25: mol_type = genomic DNA
gcatcgatgtcaacgagggcaaccg

SEQ ID NO: 386 - DNA, 25 bp, Homo sapiens
  source 1..25: mol_type = genomic DNA
cgatgtcaacgagggcaaccggaag

SEQ ID NO: 387 - DNA, 25 bp, Homo sapiens
  source 1..25: mol_type = genomic DNA
ctcaagcatcgatgtcaacgagggc

SEQ ID NO: 388 - DNA, 20 bp, Homo sapiens
  source 1..20: mol_type = genomic DNA
tccaaacttcactccatctc

SEQ ID NO: 389 - DNA, 20 bp, Homo sapiens
  source 1..20: mol_type = genomic DNA
tcgatgtcaacgagggcaac

SEQ ID NO: 390 - DNA, 20 bp, Homo sapiens
  source 1..20: mol_type = genomic DNA
ccacagctgggggatgcagg

SEQ ID NO: 391 - DNA, 25 bp, Homo sapiens
  source 1..25: mol_type = genomic DNA
tcgccatcgctgtagaacgcaccac

SEQ ID NO: 392 - DNA, 25 bp, Homo sapiens
  source 1..25: mol_type = genomic DNA
ctccctctcccagttaccatgaagt

SEQ ID NO: 393 - DNA, 25 bp, Homo sapiens
  source 1..25: mol_type = genomic DNA
aagaagtgcaagacccgggagacgg

SEQ ID NO: 394 - DNA, 25 bp, Homo sapiens
  source 1..25: mol_type = genomic DNA
tgatcaaacgccccggcaggaagtg

SEQ ID NO: 395 - DNA, 25 bp, Homo sapiens
  source 1..25: mol_type = genomic DNA
aggccattcccaagaaacggggctg

SEQ ID NO: 396 - DNA, 25 bp, Homo sapiens
  source 1..25: mol_type = genomic DNA
ctcccgggtcttgcacttcttgatg

SEQ ID NO: 397 - DNA, 25 bp, Homo sapiens
  source 1..25: mol_type = genomic DNA
tgtgtcgcctaccttttcgaagtac

SEQ ID NO: 398 - DNA, 25 bp, Homo sapiens
  source 1..25: mol_type = genomic DNA
gggatgtgtcgcctaccttttcgaa

SEQ ID NO: 399 - DNA, 25 bp, Homo sapiens
  source 1..25: mol_type = genomic DNA
ctccccggctttcagccccgtttct

SEQ ID NO: 400 - DNA, 25 bp, Homo sapiens
  source 1..25: mol_type = genomic DNA
caccacactccccggctttcagccc

SEQ ID NO: 401 - DNA, 25 bp, Homo sapiens
  source 1..25: mol_type = genomic DNA
ggcctcagcttttcgcttcctgccg

SEQ ID NO: 402 - DNA, 20 bp, Homo sapiens
  source 1..20: mol_type = genomic DNA
ggctttctttttggcctcgg

SEQ ID NO: 403 - DNA, 25 bp, Homo sapiens
  source 1..25: mol_type = genomic DNA
tacggtctcctgcacagatcgaata

SEQ ID NO: 404 - DNA, 25 bp, Homo sapiens
  source 1..25: mol_type = genomic DNA
ctcctgcacagatcgaatagaagac

SEQ ID NO: 405 - DNA, 25 bp, Homo sapiens
  source 1..25: mol_type = genomic DNA
gcacagatcgaatagaagactcctt

SEQ ID NO: 406 - DNA, 20 bp, Homo sapiens
  source 1..20: mol_type = genomic DNA
ttgatggggagtacggtctc

SEQ ID NO: 407 - DNA, 20 bp, Homo sapiens
  source 1..20: mol_type = genomic DNA
ggctccctctcccagttacc

SEQ ID NO: 408 - DNA, 25 bp, Homo sapiens
  source 1..25: mol_type = genomic DNA
gggcatcttcgtggactacagagct

SEQ ID NO: 409 - DNA, 25 bp, Homo sapiens
  source 1..25: mol_type = genomic DNA
gctactgggtggtgataatggtgaa

SEQ ID NO: 410 - DNA, 25 bp, Homo sapiens
  source 1..25: mol_type = genomic DNA
ttcagccctgggacacatgatggag

SEQ ID NO: 411 - DNA, 25 bp, Homo sapiens
  source 1..25: mol_type = genomic DNA
ggctactgggtggtgataatggtga

SEQ ID NO: 412 - DNA, 25 bp, Homo sapiens
  source 1..25: mol_type = genomic DNA
ttcagccctgggacacatgatggag

SEQ ID NO: 413 - DNA, 25 bp, Homo sapiens
  source 1..25: mol_type = genomic DNA
ggacacgtgatggagggaagaacac

SEQ ID NO: 414 - DNA, 20 bp, Homo sapiens
  source 1..20: mol_type = genomic DNA
cccgacccgcctgctaataa

SEQ ID NO: 415 - DNA, 25 bp, Homo sapiens
  source 1..25: mol_type = genomic DNA
gaagaacaggttctggacgtcaaag

SEQ ID NO: 416 - DNA, 25 bp, synthetic construct
  misc_feature 1..25: note = source = /note="Description of Artificial Sequence: Syntheticoligonucleotide"
  source 1..25: mol_type = other DNA
gtgttctcaggttatcggtaagttt

SEQ ID NO: 417 - DNA, 25 bp, Homo sapiens
  source 1..25: mol_type = genomic DNA
ggaaatgctgttagtcggtatgtcg

SEQ ID NO: 418 - DNA, 25 bp, Homo sapiens
  source 1..25: mol_type = genomic DNA
ctggggctgcttactactaccaatg

SEQ ID NO: 419 - DNA, 25 bp, Homo sapiens
  source 1..25: mol_type = genomic DNA
ctggggctgcttactactaccaatg

SEQ ID NO: 420 - DNA, 25 bp, Homo sapiens
  source 1..25: mol_type = genomic DNA
ggtttgccatccgaggggtagtgct

SEQ ID NO: 421 - DNA, 25 bp, Homo sapiens
  source 1..25: mol_type = genomic DNA
ctagtaggggctggtgacagtcaat

SEQ ID NO: 422 - DNA, 25 bp, Homo sapiens
  source 1..25: mol_type = genomic DNA
aggaccatcaccccctagactatag

SEQ ID NO: 423 - DNA, 25 bp, Homo sapiens
  source 1..25: mol_type = genomic DNA
ctgagcaccctgtacagcttcttcc

SEQ ID NO: 424 - DNA, 25 bp, Homo sapiens
  source 1..25: mol_type = genomic DNA
ggggctggtattcatgaaaggcaac

SEQ ID NO: 425 - DNA, 25 bp, Homo sapiens
  source 1..25: mol_type = genomic DNA
atcaccccctagactatagttagcc

SEQ ID NO: 426 - DNA, 25 bp, Homo sapiens
  source 1..25: mol_type = genomic DNA
acagaattactgggcgacacatagg

SEQ ID NO: 427 - DNA, 25 bp, Homo sapiens
  source 1..25: mol_type = genomic DNA
ccatcaccccctagactatagttag

SEQ ID NO: 428 - DNA, 20 bp, Homo sapiens
  source 1..20: mol_type = genomic DNA
cctagactatagttagccag

SEQ ID NO: 429 - DNA, 25 bp, Homo sapiens
  source 1..25: mol_type = genomic DNA
cagttcaattctacagtcaaatcag

SEQ ID NO: 430 - DNA, 25 bp, Homo sapiens
  source 1..25: mol_type = genomic DNA
tatcccatcagttcaattctacagt

SEQ ID NO: 431 - DNA, 25 bp, Homo sapiens
  source 1..25: mol_type = genomic DNA
ccttcaggattttttgtctgcagag

SEQ ID NO: 432 - DNA, 20 bp, Homo sapiens
  source 1..20: mol_type = genomic DNA
tgtatcccatcagttcaatt

SEQ ID NO: 433 - DNA, 20 bp, Homo sapiens
  source 1..20: mol_type = genomic DNA
caaatcaggaaaacgacctt

SEQ ID NO: 434 - DNA, 25 bp, Homo sapiens
  source 1..25: mol_type = genomic DNA
ccggccacgagaatagcagcccagg

SEQ ID NO: 435 - DNA, 25 bp, Homo sapiens
  source 1..25: mol_type = genomic DNA
cctgccagcagatctgagagggagg

SEQ ID NO: 436 - DNA, 25 bp, Homo sapiens
  source 1..25: mol_type = genomic DNA
ctgccctccctctcagatctgctgg

SEQ ID NO: 437 - DNA, 25 bp, Homo sapiens
  source 1..25: mol_type = genomic DNA
ctcagatctgctggcaggactgtgg

SEQ ID NO: 438 - DNA, 25 bp, Homo sapiens
  source 1..25: mol_type = genomic DNA
gcctggctgccctccctctcagatc

SEQ ID NO: 439 - DNA, 20 bp, Homo sapiens
  source 1..20: mol_type = genomic DNA
gccctccctctcagatctgc

SEQ ID NO: 440 - DNA, 20 bp, Homo sapiens
  source 1..20: mol_type = genomic DNA
agatctgctggcaggactgt

SEQ ID NO: 441 - DNA, 20 bp, Homo sapiens
  source 1..20: mol_type = genomic DNA
aatagcagcccaggccagcc

SEQ ID NO: 442 - DNA, 25 bp, Homo sapiens
  source 1..25: mol_type = genomic DNA
atgccgggggcaccgatgctggttt

SEQ ID NO: 443 - DNA, 25 bp, Homo sapiens
  source 1..25: mol_type = genomic DNA
gtggagctgaccagggaggagacct

SEQ ID NO: 444 - DNA, 25 bp, Homo sapiens
  source 1..25: mol_type = genomic DNA
ctgccatattgtgtgcccgcactcg

SEQ ID NO: 445 - DNA, 25 bp, Homo sapiens
  source 1..25: mol_type = genomic DNA
gccccctcaccttggacagtgagat

SEQ ID NO: 446 - DNA, 25 bp, Homo sapiens
  source 1..25: mol_type = genomic DNA
gtggagctgaccagggaggagacct

SEQ ID NO: 447 - DNA, 25 bp, Homo sapiens
  source 1..25: mol_type = genomic DNA
gctccctctgtactgtgcaggagtc

SEQ ID NO: 448 - DNA, 25 bp, Homo sapiens
  source 1..25: mol_type = genomic DNA
gtatttgaaggtctcctccggggtc

SEQ ID NO: 449 - DNA, 25 bp, Homo sapiens
  source 1..25: mol_type = genomic DNA
gacaccacggtctccctcaagtggc

SEQ ID NO: 450 - DNA, 25 bp, Homo sapiens
  source 1..25: mol_type = genomic DNA
gtccacggtgagggggccctggtgt

SEQ ID NO: 451 - DNA, 25 bp, Homo sapiens
  source 1..25: mol_type = genomic DNA
cgaggtgtgctcaccagaatggagt

SEQ ID NO: 452 - DNA, 25 bp, Homo sapiens
  source 1..25: mol_type = genomic DNA
gaggctcgccacaaggagctggagg

SEQ ID NO: 453 - DNA, 25 bp, Homo sapiens
  source 1..25: mol_type = genomic DNA
gaccaagcagccatgccagtacttc

SEQ ID NO: 454 - DNA, 25 bp, Homo sapiens
  source 1..25: mol_type = genomic DNA
ggatgggtggagagcaagttggtca

SEQ ID NO: 455 - DNA, 25 bp, Homo sapiens
  source 1..25: mol_type = genomic DNA
gcatctgcagacatagagacctgtg

SEQ ID NO: 456 - DNA, 25 bp, Homo sapiens
  source 1..25: mol_type = genomic DNA
aaagtggggatgggtggagagcaag

SEQ ID NO: 457 - DNA, 25 bp, Homo sapiens
  source 1..25: mol_type = genomic DNA
acaaagtggggatgggtggagagca

SEQ ID NO: 458 - DNA, 25 bp, Homo sapiens
  source 1..25: mol_type = genomic DNA
ggacctttgtcaatgggacacggac

SEQ ID NO: 459 - DNA, 25 bp, Homo sapiens
  source 1..25: mol_type = genomic DNA
cccgacttacagccagtaatgtcac

SEQ ID NO: 460 - DNA, 25 bp, Homo sapiens
  source 1..25: mol_type = genomic DNA
gaaagcccgacttatagccagtaat

SEQ ID NO: 461 - DNA, 25 bp, Homo sapiens
  source 1..25: mol_type = genomic DNA
ggatcgacgattatttcgactgggt

SEQ ID NO: 462 - DNA, 25 bp, Homo sapiens
  source 1..25: mol_type = genomic DNA
acccccgaatcgtgagtactgtcct

SEQ ID NO: 463 - DNA, 25 bp, Homo sapiens
  source 1..25: mol_type = genomic DNA
tgagaagggccaaggtattgtggca

SEQ ID NO: 464 - DNA, 25 bp, Homo sapiens
  source 1..25: mol_type = genomic DNA
tctcagttcgctgcgacccatacac

SEQ ID NO: 465 - DNA, 25 bp, Homo sapiens
  source 1..25: mol_type = genomic DNA
gtattacgtggcagagagttttaat

SEQ ID NO: 466 - DNA, 25 bp, Homo sapiens
  source 1..25: mol_type = genomic DNA
gcccttctcagttcgctacgaccca

SEQ ID NO: 467 - DNA, 25 bp, Homo sapiens
  source 1..25: mol_type = genomic DNA
caaggtattgtggcagcaaagttcc

SEQ ID NO: 468 - DNA, 25 bp, Homo sapiens
  source 1..25: mol_type = genomic DNA
gaagggccaaggtattgtggcagca

SEQ ID NO: 469 - DNA, 25 bp, Homo sapiens
  source 1..25: mol_type = genomic DNA
aagaccaaaaccacaggcttgagtg

SEQ ID NO: 470 - DNA, 20 bp, Homo sapiens
  source 1..20: mol_type = genomic DNA
gaagggccaaggtattgtgg

SEQ ID NO: 471 - DNA, 20 bp, Homo sapiens
  source 1..20: mol_type = genomic DNA
tgtatgggtcgcagcgaact

SEQ ID NO: 472 - DNA, 20 bp, Homo sapiens
  source 1..20: mol_type = genomic DNA
aactccatgacagtgtaatt

SEQ ID NO: 473 - DNA, 25 bp, Homo sapiens
  source 1..25: mol_type = genomic DNA
gtctcagcaggatctctcaccgtag

SEQ ID NO: 474 - DNA, 25 bp, Homo sapiens
  source 1..25: mol_type = genomic DNA
ggatgcttggcagtgggaaaaactt

SEQ ID NO: 475 - DNA, 20 bp, Homo sapiens
  source 1..20: mol_type = genomic DNA
ggacaagattgatgggttac

SEQ ID NO: 476 - DNA, 25 bp, Homo sapiens
  source 1..25: mol_type = genomic DNA
tttaacgaagccctccgtgagagct

SEQ ID NO: 477 - DNA, 25 bp, Homo sapiens
  source 1..25: mol_type = genomic DNA
aatgactgtgatccacattccccct

SEQ ID NO: 478 - DNA, 25 bp, Homo sapiens
  source 1..25: mol_type = genomic DNA
aagaacacattgagttctacgaact

SEQ ID NO: 479 - DNA, 25 bp, Homo sapiens
  source 1..25: mol_type = genomic DNA
aagctgcagccaagaagaacacatt

SEQ ID NO: 480 - DNA, 25 bp, Homo sapiens
  source 1..25: mol_type = genomic DNA
agaagctgcagccaagaagaacaca

SEQ ID NO: 481 - DNA, 20 bp, Homo sapiens
  source 1..20: mol_type = genomic DNA
cacattgagttctacgaact

SEQ ID NO: 482 - DNA, 20 bp, Homo sapiens
  source 1..20: mol_type = genomic DNA
agaagaacacattgagttct

SEQ ID NO: 483 - DNA, 25 bp, Homo sapiens
  source 1..25: mol_type = genomic DNA
tggcaggcatcattggtcagatcca

SEQ ID NO: 484 - DNA, 25 bp, Homo sapiens
  source 1..25: mol_type = genomic DNA
ccagcaccatcactcgccgggctgt

SEQ ID NO: 485 - DNA, 25 bp, Homo sapiens
  source 1..25: mol_type = genomic DNA
gaagtcgttgatggatctggccaat

SEQ ID NO: 486 - DNA, 25 bp, Homo sapiens
  source 1..25: mol_type = genomic DNA
ggatctgaccaatgatgcctgccag

SEQ ID NO: 487 - DNA, 25 bp, Homo sapiens
  source 1..25: mol_type = genomic DNA
tgaagaagtcgttgatggatctgac

SEQ ID NO: 488 - DNA, 20 bp, Homo sapiens
  source 1..20: mol_type = genomic DNA
gcaccatcactcgccgggct

SEQ ID NO: 489 - DNA, 25 bp, Homo sapiens
  source 1..25: mol_type = genomic DNA
tctctcctgggcatcaagggagtcc

SEQ ID NO: 490 - DNA, 25 bp, Homo sapiens
  source 1..25: mol_type = genomic DNA
tctctcctgggcatcaagggagtcc

SEQ ID NO: 491 - DNA, 25 bp, Homo sapiens
  source 1..25: mol_type = genomic DNA
acagtggtagatgacaaatatccac

SEQ ID NO: 492 - DNA, 25 bp, Homo sapiens
  source 1..25: mol_type = genomic DNA
tgacaaatatccactccttcaataa

SEQ ID NO: 493 - DNA, 20 bp, Homo sapiens
  source 1..20: mol_type = genomic DNA
aaaacacctacagtggtaga

SEQ ID NO: 494 - DNA, 20 bp, Homo sapiens
  source 1..20: mol_type = genomic DNA
agctctctcctgggcatcaa

SEQ ID NO: 495 - DNA, 25 bp, Homo sapiens
  source 1..25: mol_type = genomic DNA
gtccaagcagcgccactgtgggaga

SEQ ID NO: 496 - DNA, 25 bp, Homo sapiens
  source 1..25: mol_type = genomic DNA
cctccaattcaggacccacatgacg

SEQ ID NO: 497 - DNA, 25 bp, Homo sapiens
  source 1..25: mol_type = genomic DNA
aatgaacatccctgtccggccaatt

SEQ ID NO: 498 - DNA, 25 bp, Homo sapiens
  source 1..25: mol_type = genomic DNA
gattactgtgacctgtatggagggg

SEQ ID NO: 499 - DNA, 25 bp, Homo sapiens
  source 1..25: mol_type = genomic DNA
ctcagaggtcagggagggtccagac

SEQ ID NO: 500 - DNA, 25 bp, Homo sapiens
  source 1..25: mol_type = genomic DNA
aatcacaatgaacatccctgtccgg

SEQ ID NO: 501 - DNA, 25 bp, Homo sapiens
  source 1..25: mol_type = genomic DNA
ttggctgagttggtccggtattaca

SEQ ID NO: 502 - DNA, 25 bp, Homo sapiens
  source 1..25: mol_type = genomic DNA
tgatgatatctgcattgatgtaatc

SEQ ID NO: 503 - DNA, 25 bp, Homo sapiens
  source 1..25: mol_type = genomic DNA
aatctgaaacaggctcattgggatc

SEQ ID NO: 504 - DNA, 25 bp, Homo sapiens
  source 1..25: mol_type = genomic DNA
tgggatcaccatcgtgtaggacaac

SEQ ID NO: 505 - DNA, 20 bp, Homo sapiens
  source 1..20: mol_type = genomic DNA
atctgcattgatgtaatctg

SEQ ID NO: 506 - DNA, 25 bp, Homo sapiens
  source 1..25: mol_type = genomic DNA
aaatttctcccctccatacaggtca

SEQ ID NO: 507 - DNA, 25 bp, Homo sapiens
  source 1..25: mol_type = genomic DNA
caggtcacagtaatcaccagtgttc

SEQ ID NO: 508 - DNA, 25 bp, Homo sapiens
  source 1..25: mol_type = genomic DNA
tgggtgacagctccatttcttctaa

SEQ ID NO: 509 - DNA, 20 bp, Homo sapiens
  source 1..20: mol_type = genomic DNA
tctcccctccatacaggtca

SEQ ID NO: 510 - DNA, 20 bp, Homo sapiens
  source 1..20: mol_type = genomic DNA
gatatctgcattgatgtaat

SEQ ID NO: 511 - DNA, 25 bp, Homo sapiens
  source 1..25: mol_type = genomic DNA
aaaggaccgcaatgtggccacccca

SEQ ID NO: 512 - DNA, 25 bp, Homo sapiens
  source 1..25: mol_type = genomic DNA
tggggtggccacattgcggtccttt

SEQ ID NO: 513 - DNA, 25 bp, Homo sapiens
  source 1..25: mol_type = genomic DNA
tgcaggagcttcgaggcactgtggc

SEQ ID NO: 514 - DNA, 25 bp, Homo sapiens
  source 1..25: mol_type = genomic DNA
gtctcgtagtccggtgagccggtca

SEQ ID NO: 515 - DNA, 25 bp, Homo sapiens
  source 1..25: mol_type = genomic DNA
ccgtccatttaactggaatccgacc

SEQ ID NO: 516 - DNA, 25 bp, Homo sapiens
  source 1..25: mol_type = genomic DNA
gattccagttaaatggatggcaatt

SEQ ID NO: 517 - DNA, 25 bp, Homo sapiens
  source 1..25: mol_type = genomic DNA
gtaatggtgtggctgtactctccaa

SEQ ID NO: 518 - DNA, 25 bp, Homo sapiens
  source 1..25: mol_type = genomic DNA
cgctggttctgccggctgattcagc

SEQ ID NO: 519 - DNA, 25 bp, Homo sapiens
  source 1..25: mol_type = genomic DNA
ggccctgcggatccgcgccatcctc

SEQ ID NO: 520 - DNA, 25 bp, Homo sapiens
  source 1..25: mol_type = genomic DNA
ggatccgcgccatcctccgctccct

SEQ ID NO: 521 - DNA, 25 bp, Homo sapiens
  source 1..25: mol_type = genomic DNA
ggtctgatcatcgacgcttttggtg

SEQ ID NO: 522 - DNA, 25 bp, Homo sapiens
  source 1..25: mol_type = genomic DNA
ggcggaggcattggggacgagatcg

SEQ ID NO: 523 - DNA, 25 bp, Homo sapiens
  source 1..25: mol_type = genomic DNA
caaactgaaatctgtaagcaggcgg

SEQ ID NO: 524 - DNA, 25 bp, Homo sapiens
  source 1..25: mol_type = genomic DNA
ttggtgctctcctccgtggccacgc

SEQ ID NO: 525 - DNA, 25 bp, Homo sapiens
  source 1..25: mol_type = genomic DNA
ggccaaggggatccgcacgctgctc

SEQ ID NO: 526 - DNA, 25 bp, Homo sapiens
  source 1..25: mol_type = genomic DNA
gtctcagccttacgcaccttccgag

SEQ ID NO: 527 - DNA, 25 bp, Homo sapiens
  source 1..25: mol_type = genomic DNA
gaacctgatcctggccgtggtcgca

SEQ ID NO: 528 - DNA, 25 bp, Homo sapiens
  source 1..25: mol_type = genomic DNA
aagcagcaggaagcagacccaggag

SEQ ID NO: 529 - DNA, 25 bp, Homo sapiens
  source 1..25: mol_type = genomic DNA
cctgggtctgcttcctgctgcttat

SEQ ID NO: 530 - DNA, 25 bp, Homo sapiens
  source 1..25: mol_type = genomic DNA
ataaggctgtgctgaccatcgacaa

SEQ ID NO: 531 - DNA, 25 bp, Homo sapiens
  source 1..25: mol_type = genomic DNA
aggctgtgctgaccatcgacaagaa

SEQ ID NO: 532 - DNA, 25 bp, Homo sapiens
  source 1..25: mol_type = genomic DNA
ataaggctgtgctgaccatcgacaa

SEQ ID NO: 533 - DNA, 20 bp, Homo sapiens
  source 1..20: mol_type = genomic DNA
ttctctcccctccaggccgt

SEQ ID NO: 534 - DNA, 20 bp, Homo sapiens
  source 1..20: mol_type = genomic DNA
gaccatcgacaagaaaggga

SEQ ID NO: 535 - DNA, 25 bp, Homo sapiens
  source 1..25: mol_type = genomic DNA
acctgccccggtggctctgctacac

SEQ ID NO: 536 - DNA, 25 bp, Homo sapiens
  source 1..25: mol_type = genomic DNA
agtacaccaccgtcggccacatgga

SEQ ID NO: 537 - DNA, 25 bp, Homo sapiens
  source 1..25: mol_type = genomic DNA
gctcagtacaccaccgtcggccgca

SEQ ID NO: 538 - DNA, 25 bp, Homo sapiens
  source 1..25: mol_type = genomic DNA
ctactactcatggtgactcaagcct

SEQ ID NO: 539 - DNA, 25 bp, Homo sapiens
  source 1..25: mol_type = genomic DNA
tcttttcctaaactactactcatgg

SEQ ID NO: 540 - DNA, 25 bp, Homo sapiens
  source 1..25: mol_type = genomic DNA
aaactactactcatggtgactcaag

SEQ ID NO: 541 - DNA, 20 bp, Homo sapiens
  source 1..20: mol_type = genomic DNA
actcatggtgactcaagcct

SEQ ID NO: 542 - DNA, 20 bp, Homo sapiens
  source 1..20: mol_type = genomic DNA
tactttgggatctttttctt

SEQ ID NO: 543 - DNA, 25 bp, Homo sapiens
  source 1..25: mol_type = genomic DNA
attagtcagaggaaggttgagccca

SEQ ID NO: 544 - DNA, 25 bp, Homo sapiens
  source 1..25: mol_type = genomic DNA
gccaccactgctctttcccgcacgg

SEQ ID NO: 545 - DNA, 25 bp, Homo sapiens
  source 1..25: mol_type = genomic DNA
gctaaagtcaccgggcgctggaaat

SEQ ID NO: 546 - DNA, 25 bp, Homo sapiens
  source 1..25: mol_type = genomic DNA
gcctaactgatgaggagtttcgagg

SEQ ID NO: 547 - DNA, 25 bp, Homo sapiens
  source 1..25: mol_type = genomic DNA
tgccaatcgcgagcagcatccagct

SEQ ID NO: 548 - DNA, 25 bp, Homo sapiens
  source 1..25: mol_type = genomic DNA
tccaccacggctgtcgacaccaatc

SEQ ID NO: 549 - DNA, 25 bp, Homo sapiens
  source 1..25: mol_type = genomic DNA
accacggctgtcgacaccaatccca

SEQ ID NO: 550 - DNA, 25 bp, Homo sapiens
  source 1..25: mol_type = genomic DNA
agtggctccgaaggcaccgtcttct

SEQ ID NO: 551 - DNA, 25 bp, Homo sapiens
  source 1..25: mol_type = genomic DNA
gtacagggatctgccaacgatccta

SEQ ID NO: 552 - DNA, 25 bp, Homo sapiens
  source 1..25: mol_type = genomic DNA
actgctcctagtgtctgtcaggacc

SEQ ID NO: 553 - DNA, 20 bp, synthetic construct
  misc_feature 1..20: note = source = /note="Description of Artificial Sequence: Syntheticoligonucleotide"
  source 1..20: mol_type = other DNA
ccctgatcctcttgtcccac

SEQ ID NO: 554 - DNA, 20 bp, synthetic construct
  misc_feature 1..20: note = source = /note="Description of Artificial Sequence: Syntheticoligonucleotide"
  source 1..20: mol_type = other DNA
ctggagcaacaaatctgact

SEQ ID NO: 555 - DNA, 20 bp, synthetic construct
  misc_feature 1..20: note = source = /note="Description of Artificial Sequence: Syntheticoligonucleotide"
  source 1..20: mol_type = other DNA
gggggtcggggctcgcggcg

SEQ ID NO: 556 - DNA, 20 bp, synthetic construct
  misc_feature 1..20: note = source = /note="Description of Artificial Sequence: Syntheticoligonucleotide"
  source 1..20: mol_type = other DNA
ccacggctcctccgaagcga

SEQ ID NO: 557 - DNA, 110 bp, synthetic construct
  misc_feature 1..110: note = source = /note="Description of Artificial Sequence: Syntheticpolynucleotide"
  source 1..110: mol_type = other DNA
ccctgatcctcttgtcccacgttattgtactctcaataaaaagttattgagaatctacaataataaggcatcttgccgaatttaccgccctacatatgtagggcggtttt

SEQ ID NO: 558 - DNA, 110 bp, synthetic construct
  misc_feature 1..110: note = source = /note="Description of Artificial Sequence: Syntheticpolynucleotide"
  source 1..110: mol_type = other DNA
ctggagcaacaaatctgactgttattgtactctcaataaaaagttattgagaatctacaataataaggcatcttgccgaatttaccgccctacatatgtagggcggtttt

SEQ ID NO: 559 - DNA, 110 bp, synthetic construct
  misc_feature 1..110: note = source = /note="Description of Artificial Sequence: Syntheticpolynucleotide"
  source 1..110: mol_type = other DNA
gggggtcggggctcgcggcggttattgtactctcaataaaaagttattgagaatctacaataataaggcatcttgccgaatttaccgccctacatatgtagggcggtttt

SEQ ID NO: 560 - DNA, 110 bp, synthetic construct
  misc_feature 1..110: note = source = /note="Description of Artificial Sequence: Syntheticpolynucleotide"
  source 1..110: mol_type = other DNA
ccacggctcctccgaagcgagttattgtactctcaataaaaagttattgagaatctacaataataaggcatcttgccgaatttaccgccctacatatgtagggcggtttt

SEQ ID NO: 561 - DNA, 20 bp, synthetic construct
  misc_feature 1..20: note = source = /note="Description of Artificial Sequence: Syntheticoligonucleotide"
  source 1..20: mol_type = other DNA
ttgatagcttgtgcctgtcc

SEQ ID NO: 562 - DNA, 20 bp, synthetic construct
  misc_feature 1..20: note = source = /note="Description of Artificial Sequence: Syntheticoligonucleotide"
  source 1..20: mol_type = other DNA
agagtctctcagctggtaca

SEQ ID NO: 563 - DNA, 20 bp, synthetic construct
  misc_feature 1..20: note = source = /note="Description of Artificial Sequence: Syntheticoligonucleotide"
  source 1..20: mol_type = other DNA
gcgacaggggcaaagtgagt

SEQ ID NO: 564 - DNA, 20 bp, synthetic construct
  misc_feature 1..20: note = source = /note="Description of Artificial Sequence: Syntheticoligonucleotide"
  source 1..20: mol_type = other DNA
ctagcacttctcgcggctcc

SEQ ID NO: 565 - protein, 1649 aa, synthetic construct
  REGION 1..1649: note = source = /note="Description of Artificial Sequence: Syntheticpolypeptide"
MAPKKKRKVDYKDHDGDYKDHDIDYKDDDDKMAKRPAATKKAGQAKKKKSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSSSGGSSGGSSGSETPGTSESATPESSGGSSGGSMMYSIGLALGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFILTELMTKEFARFGVNDIAKLLGVKKEQLSGWRLDKKGKPEIHTLKGYRNWRKIFAEAGIDLATLPTETIDCLAKVLTLNTEREGVENTLAFELPELAEPVKSLVLDHYKELSQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDAIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIKSGGSKRPAATKKAGQAKKKK

SEQ ID NO: 566 - DNA, 110 bp, synthetic construct
  misc_feature 1..110: note = source = /note="Description of Artificial Sequence: Syntheticpolynucleotide"
  source 1..110: mol_type = other DNA
agcagctctaggccgaagtggttattgtactctcaataaaaagttattgagaatctacaataataaggcatcttgccgaatttaccgccctacatatgtagggcggtttt

SEQ ID NO: 567 - protein, 1150 aa, synthetic construct
  REGION 1..1150: note = source = /note="Description of Artificial Sequence: Syntheticpolypeptide"
MYSIGLALGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFILTELMTKEFARFGVNDIAKLLGVKKEQLSGWRLDKKGKPEIHTLKGYRNWRKIFAEAGIDLATLPTETIDCLAKVLTLNTEREGVENTLAFELPELAEPVKSLVLDHYKELSQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDAIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIK

SEQ ID NO: 568 - protein, 1054 aa, synthetic construct
  REGION 1..1054: note = source = /note="Description of Artificial Sequence: Syntheticpolypeptide"
MKEKYILGLDLGITSVGYGIINFETKKIIDAGVRLFPEANVDNNEGRRSKRGSRRLKRRRIHRLERVKLLLTEYDLINKEQIPTSNNPYQIRVKGLSEILSKDELAIALLHLAKRRGIHNINVSSEDEDASNELSTKEQINRNNKLLKDKYVCEVQLQRLKEGQIRGEKNRFKTTDILKEIDQLLKVQKDYHNLDIDFINQYKEIVETRREYFEGPGQGSPFGWNGDLKKWYEMLMGHCTYFPQELRSVKYAYSADLFNALNDLNNLIIQRDNSEKLEYHEKYHIIENVFKQKKKPTLKQIAKEIGVNPEDIKGYRITKSGTPQFTEFKLYHDLKSIVFDKSILENEAILDQIAEILTIYQDEQSIKEELNKLPEILNEQDKAEIAKLIGYNGTHRLSLKCIHLINEELWQTSRNQMEIFNYLNIKPNKVDLSEQNKIPKDMVNDFILSPVVKRTFIQSINVINKVIEKYGIPEDIIIELARENNSDDRKKFINNLQKKNEATRKRINEIIGQTGNQNAKRIVEKIRLHDQQEGKCLYSLESIALMDLLNNPQNYEVDHIIPRSVAFDNSIHNKVLVKQIENSKKGNRTPYQYLNSSDAKLSYNQFKQHILNLSKSKDRISKKKKDYLLEERDINKFEVQKEFINRNLVDTRYATRELTSYLKAYFSANNMDVKVKTINGSFTNHLRKVWRFDKYRNHGYKHHAEDALIIANADFLFKENKKLQNANKILEKPTIENNTKKVTVEKEEDYNNVFETPKLVEDIKQYRDYKFSHRVDKKPNRQLINDTLYSTRMKDEHDYIVQTITDIYGKDNTNLKKQFNKNPEKFLMYQNDPKTFEKLSIIMKQYSDEKNPLAKYYEETGEYLTKYSKKNNGPIVKKIKLLGNKVGNHLDVTNKYENSTKKLVKLSIKNYRFDVYLTEKGYKFVTIAYLNVFKKDNYYYIPKDKYQELKEKKKIKDTDQFIASFYKNDLIKLNGDLYKIIGVNSDDRNIIELDYYDIKYKDYCEINNIKGEPRIKKTIGKKTESIEKFTTDVLGNLYLHSTEKAPQLIFKRGL

SEQ ID NO: 569 - protein, 1150 aa, Enterococcus sp.
MYSIGLDLGISSVGWSVIDERTGNVIDLGIRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGVNDVVKLLGVKKERLSGWRLDKKGKPEIHTLKGYRNWRKIFAESGIDLATLPTETIDCLAKVLTLNTEREGIENTLAFELSELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESCHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQCYDVRFYNFQSANSINFKGLEQEMMPAENQFKQKPYNNGAINLNIAKYGKEGKKLRKFNTDILGKKHYLYYEKEPKNIIK

SEQ ID NO: 570 - protein, 1150 aa, synthetic construct
  REGION 1..1150: note = source = /note="Description of Artificial Sequence: Syntheticpolypeptide"
MYSIGLDLGISSVGWSVIDEETGKIVDLGIRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPTQKEFILTELMTKEFARFGVNDIAKLLGVKKEQLSGWRLDKKGKPEIHTLKGYRNWRKIFAESGIDLATLPTETIDCLAKVLTLNTEREGVENTLAFELPELAEPVKLLVLDRYKELSQSVSTQAWHRFSLKTLHLLIPELIKSTSEQNTLLEQFQLKADVRKRYSDYKKLPTKEVLTEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESCPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGNKLRKFNTDILGKKHHLSYEKEPKNIIK

SEQ ID NO: 571 - protein, 1150 aa, synthetic construct
  REGION 1..1150: note = source = /note="Description of Artificial Sequence: Syntheticpolypeptide"
MYSIGLDLGISSVGWSVIDEETGKIVDLGIRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPTQKEFILTELMTKEFARFGVNDIAKLLGVKKEQLSGWRLDKKGKPEIHTLKGYRNWRKIFAESGIDLATLPTETIDCLAKVLTLNTEREGVENTLAFELPELAEPVKLLVLDRYKELSQSVSTQAWHRFSLKTLHLLIPELIKSTSEQNTLLEQFQLKADVRKRYSDYKKLPTKEVLTEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESCPFSRKKVNNLLETRNIFDSEQVQKFLSRNLNDTRYASRLVLNTLQSFFENQDTIVRVVNGSFTHTLRKKWGADLDKTRETHHHHAIDASLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGNKLRKFNTDILGKKHHLSYEKEPKNIIK

SEQ ID NO: 572 - protein, 1150 aa, synthetic construct
  REGION 1..1150: note = source = /note="Description of Artificial Sequence: Syntheticpolypeptide"
MYSIGLDLGISSVGWSVIDEETGKIVDLGIRLFSAKNSDNNEGRRSKRGSRRLKRRRIHRLERVKLLLTEYDLINKEQIPTVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLNNLIIDGEVSLSPTQKEFILTELMTKEFARFGVNDIAKLLGVKKEQLSGWRLDKKGKPEIHTLKGYRNWRKIFAESGIDLATLPTETIDCLAKVLTLNTEREGVENTLAFELPELAEPVKLLVLDRYKELSQSVSTQAWHRLSLKCIHLINEELIKSTSEQNTLLEQFQLKADVRKRYSDYKKLPTKEVLTEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEVDHIIPRSISLDDSINNKVLVLSHANQVKGQQTPYDARMAGAFNKINGKFSNWDEYQKWVESCPFSRKKVNNLLETRNIFDSEQVQKFLSRNLVDTRYATRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHRVDKKPNRQLINDTLYSTRMKDEVKTLKSGKEKITTDEYTIGKITDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGNKLRKFTTDVLGKKHHLSYEKEPKNIIK

SEQ ID NO: 573 - protein, 1150 aa, synthetic construct
  REGION 1..1150: note = source = /note="Description of Artificial Sequence: Syntheticpolypeptide"
MYSIGLDLGISSVGWSVIDEETGKIVDLGARLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPDQKEFILTELMTKEFARFGVNDIAKLLGVKKEQLSGWRLDKKGKPEIHTLKGYRNWRKIFAEVGIDLATLPTETIDCLAKVLTLNTEREGVENTLAFELPELAEPVKTLVLDRYKELSQSLSTQAWHRFSLKTLHLLIPELIKSTSEQNTLLEQFQLKAAVRKRYSDYKKLPTKEVLVEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESKPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGRKLRKFNTDILGKKHHLSYEKEPKNIIK

SEQ ID NO: 574 - protein, 1150 aa, synthetic construct
  REGION 1..1150: note = source = /note="Description of Artificial Sequence: Syntheticpolypeptide"
MYSIGLDLGISSVGWSVIDEETGKIVDLGARLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKATAYADEIASLIKSQQAIYPNEISDDWLALFAQPGIAENAGLIYRKRPYYHGPGNEANNSPYGRWSDFQKTGQPAANIFDKLIGKDFQGELRASGLSLSAQQYNLLNDLTNLKIDGEVSLSPDQKEFLISEIMSKEFARFGANDLAKIIGAKKEQLSGWRLDKKGKPEIHTLKGYRNWRKIFAEVGLDIASIPSESLDCIAKVLTLNTEREGAENSIAFEIPEIAEPAKTIAIDRYKEITQTLSTQAWHRFSLKTLHLLIPELIKSTSEQNTLLEQFQLKAAVRKRYSDYKKLPTKEVLVEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESKPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGRKLRKFNTDILGKKHHLSYEKEPKNIIK

SEQ ID NO: 575 - protein, 1150 aa, synthetic construct
  REGION 1..1150: note = source = /note="Description of Artificial Sequence: Syntheticpolypeptide"
MYSIGLDLGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKASAYADELATLLKTQQALYPNEITDDWLALFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFLLTELMTKEFARFGVNDIAKLLGAKKEQLSGWRLDKKGKPEIHTLKGYRNWRKIFAEAGIDIASLPTETLDCLAKVLTLNTEREGVENSLAFELPELAEPVKSLVLDHYKELSQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIK

SEQ ID NO: 576 - protein, 1150 aa, synthetic construct
  REGION 1..1150: note = source = /note="Description of Artificial Sequence: Syntheticpolypeptide"
MYSIGLDLGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVTAYADELATILKTQQAIYPNEITDDWIAIFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFILTELMTKEFARFGANDIAKILGAKKEQLSGWRLDKKGKPEIHTLKGYRNWRKIFAEAGIDIATLPTETIDCLAKVLTLNTEREGAENTLAFELPELAEPAKTLVLDHYKELTQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIK

SEQ ID NO: 577 - protein, 1150 aa, synthetic construct
  REGION 1..1150: note = source = /note="Description of Artificial Sequence: Syntheticpolypeptide"
MYSIGLDLGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELASILKTQQALYPNEITDDWIAIFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFIITELMTKEFARFGVNDLAKILGVKKEQLSGWRLDKKGKPEIHTLKGYRNWRKIFAEAGLDLATIPSETLDCLAKVLTLNTEREGAENTLAFELPELAEPVKTLVLDHYKELSQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIK

SEQ ID NO: 578 - protein, 1150 aa, synthetic construct
  REGION 1..1150: note = source = /note="Description of Artificial Sequence: Syntheticpolypeptide"
MYSIGLDLGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVTAYADEIASILKTQQAIYPNEITDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFIISELMTKEFARFGVNDLAKIIGVKKEQLSGWRLDKKGKPEIHTLKGYRNWRKIFAEAGIDLATLPSETLDCLAKVLTLNTEREGAENTLAFELPELAEPVKSLVLDHYKELSQTISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIK

SEQ ID NO: 579 - protein, 1150 aa, synthetic construct
  REGION 1..1150: note = source = /note="Description of Artificial Sequence: Syntheticpolypeptide"
MYSIGLDLGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKASAYADEIASLLKTQQAIYPNELTDDWLALFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFIISELMTKEFARFGANDIAKLLGVKKEQLSGWRLDKKGKPEIHTLKGYRNWRKIFAEAGLDLATLPTETIDCLAKVLTLNTEREGAENSLAFELPELAEPVKSLALDHYKELTQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIK

SEQ ID NO: 580 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcatcaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggtgagcgcctacgccgacgagctggccaccatcctgaagacccagcaggccctgtaccccaacgagctgaccgacgactggatcgccctgttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccacccagaaggagttcatcctgaccgagctgatgaccaaggagttcgccaggttcggcgtgaacgacatcgccaagctgctgggcgtgaagaaggagcagctgagcggctggaggctggacaagaagggcaagcccgagatccacaccctgaagggctacaggaactggaggaagatcttcgccgagagcggcatcgacctggccaccctgcccaccgagaccatcgactgcctggccaaggtgctgaccctgaacaccgagagggagggcgtggagaacaccctggccttcgagctgcccgagctggccgagcccgtgaagctgctggtgctggacaggtacaaggagctgagccagagcgtgagcacccaggcctggcacaggttcagcctgaagaccctgcacctgctgatccccgagctgatcaagagcaccagcgagcagaacaccctgctggagcagttccagctgaaggccgacgtgaggaagaggtacagcgactacaagaagctgcccaccaaggaggtgctgaccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagctgccccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaacaagctgaggaagttcaacaccgacatcctgggcaagaagcaccacctgagctacgagaaggagcccaagaacatcatcaag

SEQ ID NO: 581 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcatcaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggtgagcgcctacgccgacgagctggccaccatcctgaagacccagcaggccctgtaccccaacgagctgaccgacgactggatcgccctgttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccacccagaaggagttcatcctgaccgagctgatgaccaaggagttcgccaggttcggcgtgaacgacatcgccaagctgctgggcgtgaagaaggagcagctgagcggctggaggctggacaagaagggcaagcccgagatccacaccctgaagggctacaggaactggaggaagatcttcgccgagagcggcatcgacctggccaccctgcccaccgagaccatcgactgcctggccaaggtgctgaccctgaacaccgagagggagggcgtggagaacaccctggccttcgagctgcccgagctggccgagcccgtgaagctgctggtgctggacaggtacaaggagctgagccagagcgtgagcacccaggcctggcacaggttcagcctgaagaccctgcacctgctgatccccgagctgatcaagagcaccagcgagcagaacaccctgctggagcagttccagctgaaggccgacgtgaggaagaggtacagcgactacaagaagctgcccaccaaggaggtgctgaccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagctgccccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccatcgacgccagcctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaacaagctgaggaagttcaacaccgacatcctgggcaagaagcaccacctgagctacgagaaggagcccaagaacatcatcaag

SEQ ID NO: 582 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcatcaggctgttcagcgccaagaacagcgacaacaacgagggcaggaggagcaagaggggcagcaggaggctgaagaggaggaggatccacaggctggagagggtgaagctgctgctgaccgagtacgacctgatcaacaaggagcagatccccaccgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggtgagcgcctacgccgacgagctggccaccatcctgaagacccagcaggccctgtaccccaacgagctgaccgacgactggatcgccctgttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaacaacctgatcatcgacggcgaggtgagcctgagccccacccagaaggagttcatcctgaccgagctgatgaccaaggagttcgccaggttcggcgtgaacgacatcgccaagctgctgggcgtgaagaaggagcagctgagcggctggaggctggacaagaagggcaagcccgagatccacaccctgaagggctacaggaactggaggaagatcttcgccgagagcggcatcgacctggccaccctgcccaccgagaccatcgactgcctggccaaggtgctgaccctgaacaccgagagggagggcgtggagaacaccctggccttcgagctgcccgagctggccgagcccgtgaagctgctggtgctggacaggtacaaggagctgagccagagcgtgagcacccaggcctggcacaggctgagcctgaagtgcatccacctgatcaacgaggagctgatcaagagcaccagcgagcagaacaccctgctggagcagttccagctgaaggccgacgtgaggaagaggtacagcgactacaagaagctgcccaccaaggaggtgctgaccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgaggtggaccacatcatccccaggagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagctgccccttcagcaggaagaaggtgaacaacctgctggagaccaggaacatcttcgacagcgagcaggtgcagaagttcctgagcaggaacctggtggacaccaggtacgccaccaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccacagggtggacaagaagcccaacaggcagctgatcaacgacaccctgtacagcaccaggatgaaggacgaggtgaagaccctgaagagcggcaaggagaagatcaccaccgacgagtacaccatcggcaagatcaccgacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaacaagctgaggaagttcaccaccgacgtgctgggcaagaagcaccacctgagctacgagaaggagcccaagaacatcatcaag

SEQ ID NO: 583 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgccaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggtgagcgcctacgccgacgagctggccaccatcctgaagacccagcaggccctgtaccccaacgagctgaccgacgactggatcgccctgttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccgaccagaaggagttcatcctgaccgagctgatgaccaaggagttcgccaggttcggcgtgaacgacatcgccaagctgctgggcgtgaagaaggagcagctgagcggctggaggctggacaagaagggcaagcccgagatccacaccctgaagggctacaggaactggaggaagatcttcgccgaggtgggcatcgacctggccaccctgcccaccgagaccatcgactgcctggccaaggtgctgaccctgaacaccgagagggagggcgtggagaacaccctggccttcgagctgcccgagctggccgagcccgtgaagaccctggtgctggacaggtacaaggagctgagccagagcctgagcacccaggcctggcacaggttcagcctgaagaccctgcacctgctgatccccgagctgatcaagagcaccagcgagcagaacaccctgctggagcagttccagctgaaggccgccgtgaggaagaggtacagcgactacaagaagctgcccaccaaggaggtgctggtggagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagcaagcccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaggaagctgaggaagttcaacaccgacatcctgggcaagaagcaccacctgagctacgagaaggagcccaagaacatcatcaag

SEQ ID NO: 584 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgccaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggccaccgcctacgccgacgagatcgccagcctgatcaagagccagcaggccatctaccccaacgagatcagcgacgactggctggccctgttcgcccagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccgaccagaaggagttcctgatcagcgagatcatgagcaaggagttcgccaggttcggcgccaacgacctggccaagatcatcggcgccaagaaggagcagctgagcggctggaggctggacaagaagggcaagcccgagatccacaccctgaagggctacaggaactggaggaagatcttcgccgaggtgggcctggacatcgccagcatccccagcgagagcctggactgcatcgccaaggtgctgaccctgaacaccgagagggagggcgccgagaacagcatcgccttcgagatccccgagatcgccgagcccgccaagaccatcgccatcgacaggtacaaggagatcacccagaccctgagcacccaggcctggcacaggttcagcctgaagaccctgcacctgctgatccccgagctgatcaagagcaccagcgagcagaacaccctgctggagcagttccagctgaaggccgccgtgaggaagaggtacagcgactacaagaagctgcccaccaaggaggtgctggtggagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagcaagcccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaggaagctgaggaagttcaacaccgacatcctgggcaagaagcaccacctgagctacgagaaggagcccaagaacatcatcaag

SEQ ID NO: 585 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgtgaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggccagcgcctacgccgacgagctggccaccctgctgaagacccagcaggccctgtaccccaacgagatcaccgacgactggctggccctgttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccgagcagaaggagttcctgctgaccgagctgatgaccaaggagttcgccaggttcggcgtgaacgacatcgccaagctgctgggcgccaagaaggagcagctgagcggctggaggctggacaagaagggcaagcccgagatccacaccctgaagggctacaggaactggaggaagatcttcgccgaggccggcatcgacatcgccagcctgcccaccgagaccctggactgcctggccaaggtgctgaccctgaacaccgagagggagggcgtggagaacagcctggccttcgagctgcccgagctggccgagcccgtgaagagcctggtgctggaccactacaaggagctgagccagagcatcagcacccaggcctggcacaggttcagcctgaagaccctgcacctgctgatccccgagctgatcaagagcaccagcgagcagaacaccctgctggagcagttccagctgaaggccggcgtgaggaagaggtacagcgactacaagaagctgcccaccaaggaggtgctggccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagcaggcccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaagaagctgaggaagttcaacaccgacatcctgggcaagaagcaccacctgagctacgagaaggagcccaagaacatcatcaag

SEQ ID NO: 586 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgtgaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggtgaccgcctacgccgacgagctggccaccatcctgaagacccagcaggccatctaccccaacgagatcaccgacgactggatcgccatcttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccgagcagaaggagttcatcctgaccgagctgatgaccaaggagttcgccaggttcggcgccaacgacatcgccaagatcctgggcgccaagaaggagcagctgagcggctggaggctggacaagaagggcaagcccgagatccacaccctgaagggctacaggaactggaggaagatcttcgccgaggccggcatcgacatcgccaccctgcccaccgagaccatcgactgcctggccaaggtgctgaccctgaacaccgagagggagggcgccgagaacaccctggccttcgagctgcccgagctggccgagcccgccaagaccctggtgctggaccactacaaggagctgacccagagcatcagcacccaggcctggcacaggttcagcctgaagaccctgcacctgctgatccccgagctgatcaagagcaccagcgagcagaacaccctgctggagcagttccagctgaaggccggcgtgaggaagaggtacagcgactacaagaagctgcccaccaaggaggtgctggccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagcaggcccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaagaagctgaggaagttcaacaccgacatcctgggcaagaagcaccacctgagctacgagaaggagcccaagaacatcatcaag

SEQ ID NO: 587 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgtgaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggtgagcgcctacgccgacgagctggccagcatcctgaagacccagcaggccctgtaccccaacgagatcaccgacgactggatcgccatcttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccgagcagaaggagttcatcatcaccgagctgatgaccaaggagttcgccaggttcggcgtgaacgacctggccaagatcctgggcgtgaagaaggagcagctgagcggctggaggctggacaagaagggcaagcccgagatccacaccctgaagggctacaggaactggaggaagatcttcgccgaggccggcctggacctggccaccatccccagcgagaccctggactgcctggccaaggtgctgaccctgaacaccgagagggagggcgccgagaacaccctggccttcgagctgcccgagctggccgagcccgtgaagaccctggtgctggaccactacaaggagctgagccagagcatcagcacccaggcctggcacaggttcagcctgaagaccctgcacctgctgatccccgagctgatcaagagcaccagcgagcagaacaccctgctggagcagttccagctgaaggccggcgtgaggaagaggtacagcgactacaagaagctgcccaccaaggaggtgctggccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagcaggcccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaagaagctgaggaagttcaacaccgacatcctgggcaagaagcaccacctgagctacgagaaggagcccaagaacatcatcaag

SEQ ID NO: 588 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgtgaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggtgaccgcctacgccgacgagatcgccagcatcctgaagacccagcaggccatctaccccaacgagatcaccgacgactggatcgccctgttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccgagcagaaggagttcatcatcagcgagctgatgaccaaggagttcgccaggttcggcgtgaacgacctggccaagatcatcggcgtgaagaaggagcagctgagcggctggaggctggacaagaagggcaagcccgagatccacaccctgaagggctacaggaactggaggaagatcttcgccgaggccggcatcgacctggccaccctgcccagcgagaccctggactgcctggccaaggtgctgaccctgaacaccgagagggagggcgccgagaacaccctggccttcgagctgcccgagctggccgagcccgtgaagagcctggtgctggaccactacaaggagctgagccagaccatcagcacccaggcctggcacaggttcagcctgaagaccctgcacctgctgatccccgagctgatcaagagcaccagcgagcagaacaccctgctggagcagttccagctgaaggccggcgtgaggaagaggtacagcgactacaagaagctgcccaccaaggaggtgctggccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagcaggcccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaagaagctgaggaagttcaacaccgacatcctgggcaagaagcaccacctgagctacgagaaggagcccaagaacatcatcaag

SEQ ID NO: 589 - DNA, 3450 bp, synthetic construct
  misc_feature 1..3450: note = source = /note="Description of Artificial Sequence: Syntheticpolynucleotide"
  source 1..3450: mol_type = other DNA
atgtacagcatcggcctggacctgggcatcagcagcgtgggctggagcgtgatcgacgaggagaccggcaagatcgtggacctgggcgtgaggctgttcagcgccaagaacagcgagaagaacctggagaggaggaccagcaggggcgccaggaggctgatcaggaggaagaccaacaggctgaaggacgccaagaagctgctggaggccatcggcttctacgaggacaaggccctgaagaacgtgtgcccctaccagctgagggtgaagggcctgaccgagggcctgaccaagggcgagctgtacaaggtggtgctgcacatcgtgaagaagaggggcatcagctacctggacgaggacgacgccgaggccgccaaggagagccaggactacaaggagcaggtgaggaagaacgcccagctgctgaccaagtacacccccggccagatccagctgcagaggctgaaggagaacaacagggtgaagaccggcatcaacggccagggccactaccagctgaacgtgttcaaggccagcgcctacgccgacgagatcgccagcctgctgaagacccagcaggccatctaccccaacgagctgaccgacgactggctggccctgttcgtgcagcccggcatcgccgagaacgccggcctgatctacaggaagaggccctactaccacggccccggcaacgaggccaacaacagcccctacggcaggtggagcgacttccagaagaccggccagcccgccgccaacatcttcgacaagctgatcggcaaggacttccagggcgagctgagggccagcggcctgagcctgagcgcccagcagtacaacctgctgaacgacctgaccaacctgaagatcgacggcgaggtgagcctgagccccgagcagaaggagttcatcatcagcgagctgatgaccaaggagttcgccaggttcggcgccaacgacatcgccaagctgctgggcgtgaagaaggagcagctgagcggctggaggctggacaagaagggcaagcccgagatccacaccctgaagggctacaggaactggaggaagatcttcgccgaggccggcctggacctggccaccctgcccaccgagaccatcgactgcctggccaaggtgctgaccctgaacaccgagagggagggcgccgagaacagcctggccttcgagctgcccgagctggccgagcccgtgaagagcctggccctggaccactacaaggagctgacccagagcatcagcacccaggcctggcacaggttcagcctgaagaccctgcacctgctgatccccgagctgatcaagagcaccagcgagcagaacaccctgctggagcagttccagctgaaggccggcgtgaggaagaggtacagcgactacaagaagctgcccaccaaggaggtgctggccgagatctacaaccccaccgtgaacaagaccgtgagccaggccttcaaggtgatggacgccctgctggagaagtacggcaaggaccagatccactacatcaccgtggagatgcccagggacgacaacgaggaggaggagaggaagaggatcaaggagctgcagaccaagaacagccagaggaagaacgacagccagcagtacttcctgcagaagagcggctggagccaggagaagttccaggccaccatccacaagaacaggaggttcctggccaagctgctgtactacttcgagcaggacggcgtgtgcgcctacaccggcaaccccatcagccccgagctgctggtgagcgacagcaccgagatcgaccacatcatccccatcagcatcagcctggacgacagcatcaacaacaaggtgctggtgctgagccacgccaaccaggtgaagggccagcagaccccctacgacgccaggatggccggcgccttcaacaagatcaacggcaagttcagcaactgggacgagtaccagaagtgggtggagagcaggcccttcagcaggaagaaggtgaacaacctgctggagaccaggaacatcttcgacagcgagcaggtgcagaagttcctgagcaggaacctgaacgacaccaggtacgccagcaggctggtgctgaacaccctgcagagcttcttcgagaaccaggacaccatcgtgagggtggtgaacggcagcttcacccacaccctgaggaagaagtggggcgccgacctggacaagaccagggagacccaccaccaccacgccgtggacgccaccctgtgcgccgtgacccccttcgtgaaggtgagcaggtaccactacgccgtgaacgaggagaccggcgagaagttcatgagggagatcgacgtggagaccggcgagatcctggacgagatcccctacagggagtacaagaaggccaagcactacgagaggaagacctaccaggtgaagtggagcaacttcagggagcagctgaagcccatcaccatccaccccaagatcaagttcagccaccaggtggacaggaaggccaacaggaagctgagcgacgccaccatctacagcgtgagggagaagaccgaggtgaagaccctgaagagcggcaaggagaagatcaccaccgacgagtacaccatcggcaagatcaaggacatctacaccgtggacggctgggaggccttcaagaagaagcaggacaagctgctgatgaaggagttcgacgagaagacctacgagctgctggtgaccatcgccgccaccacccccgacttccaggaggtggaggagaagaacggcaaggtgaagagggtgaagaggagccccttcgccgtgtactgcgaggagaacggcatccccgccatcaggaagtacgccaagaagaacaacggccccgtgatcaggagcctgaagtactacgacggcaagctgaacaagcacatcaacatcaccaaggacgagaagggcaggcccgtggagcagaccaagaacggcaggaaggtgaccctgcagagcctgaagccctacaggtacgacatctaccaggacctggagaccaaggcctactacaccgtgcagctgtactacagcgacctgaggttcgtggagggcgagtacggcatcaccgagaaggagtacatgaagaaggtggccgagcagaccaagggccaggtggtgaggttctgcttcagcctgcagaagaacgacggcctggagatcgagtggaaggacagccagaggtacgacgtgaggttctacaacttccagagcgccaacagcatcaacttcaagggcctggagcaggagatgatccccgccgagaaccagttcaagcagaagccctacaacaacggcgccatcaacctgaacatcgccaagtacggcaaggagggcaagaagctgaggaagttcaacaccgacatcctgggcaagaagcaccacctgagctacgagaaggagcccaagaacatcatcaag

SEQ ID NO: 590 - DNA, 20 bp, synthetic construct
  misc_feature 1..20: note = source = /note="Description of Artificial Sequence: Syntheticoligonucleotide"
  source 1..20: mol_type = other DNA
accggaggacaaagtacaaa

SEQ ID NO: 591 - RNA, 110 nt, synthetic construct
  misc_feature 1..110: note = source = /note="Description of Artificial Sequence: Syntheticpolynucleotide"
  source 1..110: mol_type = other RNA
accggaggacaaagtacaaagttattgtactctcaataaaaagttattgagaatctacaataataaggcatcttgccgaatttaccgccctacatatgtagggcggtttt

SEQ ID NO: 592 - DNA, 20 bp, synthetic construct
  misc_feature 1..20: note = source = /note="Description of Artificial Sequence: Syntheticprimer"
  source 1..20: mol_type = other DNA
tgttagacccatgggagcag

SEQ ID NO: 593 - DNA, 19 bp, synthetic construct
  misc_feature 1..19: note = source = /note="Description of Artificial Sequence: Syntheticprimer"
  source 1..19: mol_type = other DNA
gttgcccaccctagtcatt

SEQ ID NO: 594 - DNA, 20 bp, synthetic construct
  misc_feature 1..20: note = source = /note="Description of Artificial Sequence: Syntheticoligonucleotide"
  source 1..20: mol_type = other DNA
tggatttagagtctctcagc

SEQ ID NO: 595 - RNA, 110 nt, synthetic construct
  misc_feature 1..110: note = source = /note="Description of Artificial Sequence: Syntheticpolynucleotide"
  source 1..110: mol_type = other RNA
tggatttagagtctctcagcgttattgtactctcaataaaaagttattgagaatctacaataataaggcatcttgccgaatttaccgccctacatatgtagggcggtttt

SEQ ID NO: 596 - DNA, 20 bp, synthetic construct
  misc_feature 1..20: note = source = /note="Description of Artificial Sequence: Syntheticprimer"
  source 1..20: mol_type = other DNA
gggcaaagagggaaatgaga

SEQ ID NO: 597 - DNA, 20 bp, synthetic construct
  misc_feature 1..20: note = source = /note="Description of Artificial Sequence: Syntheticprimer"
  source 1..20: mol_type = other DNA
gaacctggccattcctgaag

SEQ ID NO: 598 - DNA, 20 bp, synthetic construct
  misc_feature 1..20: note = source = /note="Description of Artificial Sequence: Syntheticoligonucleotide"
  source 1..20: mol_type = other DNA
ccctgatcctcttgtcccac

SEQ ID NO: 599 - RNA, 110 nt, synthetic construct
  misc_feature 1..110: note = source = /note="Description of Artificial Sequence: Syntheticpolynucleotide"
  source 1..110: mol_type = other RNA
ccctgatcctcttgtcccacgttattgtactctcaataaaaagttattgagaatctacaataataaggcatcttgccgaatttaccgccctacatatgtagggcggtttt

SEQ ID NO: 600 - DNA, 20 bp, synthetic construct
  misc_feature 1..20: note = source = /note="Description of Artificial Sequence: Syntheticoligonucleotide"
  source 1..20: mol_type = other DNA
ctggagcaacaaatctgact

SEQ ID NO: 601 - RNA, 110 nt, synthetic construct
  misc_feature 1..110: note = source = /note="Description of Artificial Sequence: Syntheticpolynucleotide"
  source 1..110: mol_type = other RNA
ctggagcaacaaatctgactgttattgtactctcaataaaaagttattgagaatctacaataataaggcatcttgccgaatttaccgccctacatatgtagggcggtttt

SEQ ID NO: 602 - DNA, 20 bp, synthetic construct
  misc_feature 1..20: note = source = /note="Description of Artificial Sequence: Syntheticoligonucleotide"
  source 1..20: mol_type = other DNA
gggggtcggggctcgcggcg

SEQ ID NO: 603 - RNA, 110 nt, synthetic construct
  misc_feature 1..110: note = source = /note="Description of Artificial Sequence: Syntheticpolynucleotide"
  source 1..110: mol_type = other RNA
gggggtcggggctcgcggcggttattgtactctcaataaaaagttattgagaatctacaataataaggcatcttgccgaatttaccgccctacatatgtagggcggtttt

SEQ ID NO: 604 - DNA, 20 bp, synthetic construct
  misc_feature 1..20: note = source = /note="Description of Artificial Sequence: Syntheticprimer"
  source 1..20: mol_type = other DNA
gcaaagtgagtgacctgctt

SEQ ID NO: 605 - DNA, 18 bp, synthetic construct
  misc_feature 1..18: note = source = /note="Description of Artificial Sequence: Syntheticprimer"
  source 1..18: mol_type = other DNA
gagctagcacttctcgcg

SEQ ID NO: 606 - DNA, 20 bp, synthetic construct
  misc_feature 1..20: note = source = /note="Description of Artificial Sequence: Syntheticoligonucleotide"
  source 1..20: mol_type = other DNA
ccacggctcctccgaagcga

SEQ ID NO: 607 - RNA, 110 nt, synthetic construct
  misc_feature 1..110: note = source = /note="Description of Artificial Sequence: Syntheticpolynucleotide"
  source 1..110: mol_type = other RNA
ccacggctcctccgaagcgagttattgtactctcaataaaaagttattgagaatctacaataataaggcatcttgccgaatttaccgccctacatatgtagggcggtttt

SEQ ID NO: 608 - protein, 1493 aa, synthetic construct
  REGION 1..1493: note = source = /note="Description of Artificial Sequence: Syntheticpolypeptide"
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 609 - DNA, 25 bp, synthetic construct
  misc_feature 1..25: note = source = /note="Description of Artificial Sequence: Syntheticoligonucleotide"
  source 1..25: mol_type = other DNA
gttttaatggcccagcctcacaccc

SEQ ID NO: 610 - DNA, 20 bp, synthetic construct
  misc_feature 1..20: note = source = /note="Description of Artificial Sequence: Syntheticoligonucleotide"
  source 1..20: mol_type = other DNA
accggaggacaaagtacaaa

SEQ ID NO: 611 - DNA, 20 bp, synthetic construct
  misc_feature 1..20: note = source = /note="Description of Artificial Sequence: Syntheticoligonucleotide"
  source 1..20: mol_type = other DNA
tggatttagagtctctcagc

SEQ ID NO: 612 - DNA, 20 bp, synthetic construct
  misc_feature 1..20: note = source = /note="Description of Artificial Sequence: Syntheticoligonucleotide"
  source 1..20: mol_type = other DNA
ccctgatcctcttgtcccac

SEQ ID NO: 613 - DNA, 20 bp, synthetic construct
  misc_feature 1..20: note = source = /note="Description of Artificial Sequence: Syntheticoligonucleotide"
  source 1..20: mol_type = other DNA
ctggagcaacaaatctgact

SEQ ID NO: 614 - DNA, 20 bp, synthetic construct
  misc_feature 1..20: note = source = /note="Description of Artificial Sequence: Syntheticoligonucleotide"
  source 1..20: mol_type = other DNA
gggggtcggggctcgcggcg

SEQ ID NO: 615 - DNA, 20 bp, synthetic construct
  misc_feature 1..20: note = source = /note="Description of Artificial Sequence: Syntheticoligonucleotide"
  source 1..20: mol_type = other DNA
ccacggctcctccgaagcga

SEQ ID NO: 616 - DNA, 20 bp, synthetic construct
  misc_feature 1..20: note = source = /note="Description of Artificial Sequence: Syntheticoligonucleotide"
  source 1..20: mol_type = other DNA
gtcagaaatagggggtccag

SEQ ID NO: 617 - DNA, 20 bp, synthetic construct
  misc_feature 1..20: note = source = /note="Description of Artificial Sequence: Syntheticoligonucleotide"
  source 1..20: mol_type = other DNA
cctgaatgctgtgcggctct

SEQ ID NO: 618 - DNA, 20 bp, synthetic construct
  misc_feature 1..20: note = source = /note="Description of Artificial Sequence: Syntheticoligonucleotide"
  source 1..20: mol_type = other DNA
cgaccccctccaccccgcct

SEQ ID NO: 619 - DNA, 20 bp, synthetic construct
  misc_feature 1..20: note = source = /note="Description of Artificial Sequence: Syntheticoligonucleotide"
  source 1..20: mol_type = other DNA
ggggtggggggagtttgctc

SEQ ID NO: 620 - DNA, 20 bp, synthetic construct
  misc_feature 1..20: note = source = /note="Description of Artificial Sequence: Syntheticoligonucleotide"
  source 1..20: mol_type = other DNA
aggtcagaaatagggggtcc

SEQ ID NO: 621 - DNA, 20 bp, synthetic construct
  misc_feature 1..20: note = source = /note="Description of Artificial Sequence: Syntheticoligonucleotide"
  source 1..20: mol_type = other DNA
tgagaaaggacaggcggcag

SEQ ID NO: 622 - DNA, 20 bp, synthetic construct
  misc_feature 1..20: note = source = /note="Description of Artificial Sequence: Syntheticoligonucleotide"
  source 1..20: mol_type = other DNA
ctctgcttccaggtgacagt

SEQ ID NO: 623 - DNA, 20 bp, synthetic construct
  misc_feature 1..20: note = source = /note="Description of Artificial Sequence: Syntheticoligonucleotide"
  source 1..20: mol_type = other DNA
tgcgcatctccctggtcacc

SEQ ID NO: 624 - DNA, 20 bp, synthetic construct
  misc_feature 1..20: note = source = /note="Description of Artificial Sequence: Syntheticoligonucleotide"
  source 1..20: mol_type = other DNA
aaaatctgctcttagggctc

SEQ ID NO: 625 - DNA, 20 bp, synthetic construct
  misc_feature 1..20: note = source = /note="Description of Artificial Sequence: Syntheticoligonucleotide"
  source 1..20: mol_type = other DNA
gatgctctaatgtactgcca

SEQ ID NO: 626 - DNA, 20 bp, synthetic construct
  misc_feature 1..20: note = source = /note="Description of Artificial Sequence: Syntheticoligonucleotide"
  source 1..20: mol_type = other DNA
ctgggccattaaaacctctc

SEQ ID NO: 627 - DNA, 25 bp, synthetic construct
  misc_feature 1..25: note = source = /note="Description of Artificial Sequence: Syntheticoligonucleotide"
  source 1..25: mol_type = other DNA
cctcacccccacgagcttgtaggaa

SEQ ID NO: 628 - DNA, 25 bp, synthetic construct
  misc_feature 1..25: note = source = /note="Description of Artificial Sequence: Syntheticoligonucleotide"
  source 1..25: mol_type = other DNA
atccagtgtgtgaagaagcgggacc

SEQ ID NO: 629 - DNA, 25 bp, synthetic construct
  misc_feature 1..25: note = source = /note="Description of Artificial Sequence: Syntheticoligonucleotide"
  source 1..25: mol_type = other DNA
acagtgcgcatctccctggtcacca

SEQ ID NO: 630 - DNA, 25 bp, synthetic construct
  misc_feature 1..25: note = source = /note="Description of Artificial Sequence: Syntheticoligonucleotide"
  source 1..25: mol_type = other DNA
cctcacccccacgagcttgtaggaa

SEQ ID NO: 631 - DNA, 25 bp, synthetic construct
  misc_feature 1..25: note = source = /note="Description of Artificial Sequence: Syntheticoligonucleotide"
  source 1..25: mol_type = other DNA
atccagtgtgtgaagaagcgggacc

SEQ ID NO: 632 - DNA, 25 bp, synthetic construct
  misc_feature 1..25: note = source = /note="Description of Artificial Sequence: Syntheticoligonucleotide"
  source 1..25: mol_type = other DNA
acagtgcgcatctccctggtcacca

SEQ ID NO: 633 - DNA, 25 bp, synthetic construct
  misc_feature 1..25: note = source = /note="Description of Artificial Sequence: Syntheticoligonucleotide"
  source 1..25: mol_type = other DNA
cctcacccccacgagcttgtaggaa

SEQ ID NO: 634 - DNA, 25 bp, synthetic construct
  misc_feature 1..25: note = source = /note="Description of Artificial Sequence: Syntheticoligonucleotide"
  source 1..25: mol_type = other DNA
atccagtgtgtgaagaagcgggacc

SEQ ID NO: 635 - DNA, 25 bp, synthetic construct
  misc_feature 1..25: note = source = /note="Description of Artificial Sequence: Syntheticoligonucleotide"
  source 1..25: mol_type = other DNA
acagtgcgcatctccctggtcacca

SEQ ID NO: 636 - DNA, 20 bp, synthetic construct
  misc_feature 1..20: note = source = /note="Description of Artificial Sequence: Syntheticoligonucleotide"
  source 1..20: mol_type = other DNA
atcccatctttgacaatcgt

SEQ ID NO: 637 - DNA, 20 bp, synthetic construct
  misc_feature 1..20: note = source = /note="Description of Artificial Sequence: Syntheticoligonucleotide"
  source 1..20: mol_type = other DNA
cgattgtcaaagatgggatg

SEQ ID NO: 638 - DNA, 20 bp, synthetic construct
  misc_feature 1..20: note = source = /note="Description of Artificial Sequence: Syntheticoligonucleotide"
  source 1..20: mol_type = other DNA
acgattgtcaaagatgggat

SEQ ID NO: 639 - DNA, 20 bp, synthetic construct
  misc_feature 1..20: note = source = /note="Description of Artificial Sequence: Syntheticoligonucleotide"
  source 1..20: mol_type = other DNA
tgtagccattgatctgtcca

SEQ ID NO: 640 - DNA, 20 bp, synthetic construct
  misc_feature 1..20: note = source = /note="Description of Artificial Sequence: Syntheticoligonucleotide"
  source 1..20: mol_type = other DNA
ctgtgtagccattgatctgt

SEQ ID NO: 641 - DNA, 20 bp, synthetic construct
  misc_feature 1..20: note = source = /note="Description of Artificial Sequence: Syntheticoligonucleotide"
  source 1..20: mol_type = other DNA
cctgtgtagccattgatctg

SEQ ID NO: 642 - DNA, 20 bp, synthetic construct
  misc_feature 1..20: note = source = /note="Description of Artificial Sequence: Syntheticoligonucleotide"
  source 1..20: mol_type = other DNA
cagacatccaaacctgactc

SEQ ID NO: 643 - DNA, 20 bp, synthetic construct
  misc_feature 1..20: note = source = /note="Description of Artificial Sequence: Syntheticoligonucleotide"
  source 1..20: mol_type = other DNA
ccagacatccaaacctgact

SEQ ID NO: 644 - DNA, 20 bp, synthetic construct
  misc_feature 1..20: note = source = /note="Description of Artificial Sequence: Syntheticoligonucleotide"
  source 1..20: mol_type = other DNA
ccccagccctctgtgtttgg

SEQ ID NO: 645 - DNA, 20 bp, synthetic construct
  misc_feature 1..20: note = source = /note="Description of Artificial Sequence: Syntheticoligonucleotide"
  source 1..20: mol_type = other DNA
ttcaccgattttgattctca

SEQ ID NO: 646 - DNA, 20 bp, synthetic construct
  misc_feature 1..20: note = source = /note="Description of Artificial Sequence: Syntheticoligonucleotide"
  source 1..20: mol_type = other DNA
acagtgctgtggcctggagc

SEQ ID NO: 647 - DNA, 20 bp, synthetic construct
  misc_feature 1..20: note = source = /note="Description of Artificial Sequence: Syntheticoligonucleotide"
  source 1..20: mol_type = other DNA
ccgtgtaccagctgagagac

SEQ ID NO: 648 - DNA, 20 bp, synthetic construct
  misc_feature 1..20: note = source = /note="Description of Artificial Sequence: Syntheticoligonucleotide"
  source 1..20: mol_type = other DNA
cagtgctgtggcctggagca

SEQ ID NO: 649 - DNA, 20 bp, synthetic construct
  misc_feature 1..20: note = source = /note="Description of Artificial Sequence: Syntheticoligonucleotide"
  source 1..20: mol_type = other DNA
cgtgtaccagctgagagact

SEQ ID NO: 650 - DNA, 20 bp, synthetic construct
  misc_feature 1..20: note = source = /note="Description of Artificial Sequence: Syntheticoligonucleotide"
  source 1..20: mol_type = other DNA
ctattcaccgattttgattc

SEQ ID NO: 651 - DNA, 20 bp, synthetic construct
  misc_feature 1..20: note = source = /note="Description of Artificial Sequence: Syntheticoligonucleotide"
  source 1..20: mol_type = other DNA
catagacctcatgtctagca

SEQ ID NO: 652 - DNA, 20 bp, synthetic construct
  misc_feature 1..20: note = source = /note="Description of Artificial Sequence: Syntheticoligonucleotide"
  source 1..20: mol_type = other DNA
tatctgtgggacaagaggat

SEQ ID NO: 653 - DNA, 20 bp, synthetic construct
  misc_feature 1..20: note = source = /note="Description of Artificial Sequence: Syntheticoligonucleotide"
  source 1..20: mol_type = other DNA
gtctctcagctggtacacgg

SEQ ID NO: 654 - DNA, 20 bp, synthetic construct
  misc_feature 1..20: note = source = /note="Description of Artificial Sequence: Syntheticoligonucleotide"
  source 1..20: mol_type = other DNA
tgtgctagacatgaggtcta

SEQ ID NO: 655 - DNA, 20 bp, synthetic construct
  misc_feature 1..20: note = source = /note="Description of Artificial Sequence: Syntheticoligonucleotide"
  source 1..20: mol_type = other DNA
tctgtgggacaagaggatca

SEQ ID NO: 656 - DNA, 20 bp, synthetic construct
  misc_feature 1..20: note = source = /note="Description of Artificial Sequence: Syntheticoligonucleotide"
  source 1..20: mol_type = other DNA
ctctcagctggtacacggca

SEQ ID NO: 657 - DNA, 20 bp, synthetic construct
  misc_feature 1..20: note = source = /note="Description of Artificial Sequence: Syntheticoligonucleotide"
  source 1..20: mol_type = other DNA
tgtgctagacatgaggtcta

SEQ ID NO: 658 - DNA, 20 bp, synthetic construct
  misc_feature 1..20: note = source = /note="Description of Artificial Sequence: Syntheticoligonucleotide"
  source 1..20: mol_type = other DNA
tctgtgggacaagaggatca

SEQ ID NO: 659 - DNA, 20 bp, synthetic construct
  misc_feature 1..20: note = source = /note="Description of Artificial Sequence: Syntheticoligonucleotide"
  source 1..20: mol_type = other DNA
ctctcagctggtacacggca

SEQ ID NO: 660 - DNA, 20 bp, synthetic construct
  misc_feature 1..20: note = source = /note="Description of Artificial Sequence: Syntheticoligonucleotide"
  source 1..20: mol_type = other DNA
ctctcagctggtacacggca

SEQ ID NO: 661 - DNA, 20 bp, synthetic construct
  misc_feature 1..20: note = source = /note="Description of Artificial Sequence: Syntheticoligonucleotide"
  source 1..20: mol_type = other DNA
tgtgctagacatgaggtcta

SEQ ID NO: 662 - DNA, 20 bp, synthetic construct
  misc_feature 1..20: note = source = /note="Description of Artificial Sequence: Syntheticoligonucleotide"
  source 1..20: mol_type = other DNA
tctgtgggacaagaggatca

SEQ ID NO: 663 - DNA, 20 bp, synthetic construct
  misc_feature 1..20: note = source = /note="Description of Artificial Sequence: Syntheticoligonucleotide"
  source 1..20: mol_type = other DNA
ctctcagctggtacacggca

SEQ ID NO: 664 - DNA, 20 bp, synthetic construct
  misc_feature 1..20: note = source = /note="Description of Artificial Sequence: Syntheticoligonucleotide"
  source 1..20: mol_type = other DNA
atgttgttcataatcattga

SEQ ID NO: 665 - DNA, 20 bp, synthetic construct
  misc_feature 1..20: note = source = /note="Description of Artificial Sequence: Syntheticoligonucleotide"
  source 1..20: mol_type = other DNA
tcaatgattatgaacaacat

SEQ ID NO: 666 - DNA, 20 bp, synthetic construct
  misc_feature 1..20: note = source = /note="Description of Artificial Sequence: Syntheticoligonucleotide"
  source 1..20: mol_type = other DNA
caggtctggggcaaatgatg

SEQ ID NO: 667 - DNA, 20 bp, synthetic construct
  misc_feature 1..20: note = source = /note="Description of Artificial Sequence: Syntheticoligonucleotide"
  source 1..20: mol_type = other DNA
caatgattatgaacaacatg

SEQ ID NO: 668 - DNA, 20 bp, synthetic construct
  misc_feature 1..20: note = source = /note="Description of Artificial Sequence: Syntheticoligonucleotide"
  source 1..20: mol_type = other DNA
aggtctggggcaaatgatga

SEQ ID NO: 669 - DNA, 20 bp, synthetic construct
  misc_feature 1..20: note = source = /note="Description of Artificial Sequence: Syntheticoligonucleotide"
  source 1..20: mol_type = other DNA
aggatgctccggaatgttgc

SEQ ID NO: 670 - DNA, 20 bp, synthetic construct
  misc_feature 1..20: note = source = /note="Description of Artificial Sequence: Syntheticoligonucleotide"
  source 1..20: mol_type = other DNA
ttgatacaaattagccgggg

SEQ ID NO: 671 - DNA, 20 bp, synthetic construct
  misc_feature 1..20: note = source = /note="Description of Artificial Sequence: Syntheticoligonucleotide"
  source 1..20: mol_type = other DNA
caggtctggggcaaatgatg

SEQ ID NO: 672 - DNA, 20 bp, synthetic construct
  misc_feature 1..20: note = source = /note="Description of Artificial Sequence: Syntheticoligonucleotide"
  source 1..20: mol_type = other DNA
gctccggaatgttgctgaaa

SEQ ID NO: 673 - DNA, 20 bp, synthetic construct
  misc_feature 1..20: note = source = /note="Description of Artificial Sequence: Syntheticoligonucleotide"
  source 1..20: mol_type = other DNA
cattgatacaaattagccgg

SEQ ID NO: 674 - DNA, 20 bp, synthetic construct
  misc_feature 1..20: note = source = /note="Description of Artificial Sequence: Syntheticoligonucleotide"
  source 1..20: mol_type = other DNA
ggcaaatgatgaagaaactt

SEQ ID NO: 675 - DNA, 20 bp, synthetic construct
  misc_feature 1..20: note = source = /note="Description of Artificial Sequence: Syntheticoligonucleotide"
  source 1..20: mol_type = other DNA
gcaacattccggagcatcct

SEQ ID NO: 676 - DNA, 20 bp, synthetic construct
  misc_feature 1..20: note = source = /note="Description of Artificial Sequence: Syntheticoligonucleotide"
  source 1..20: mol_type = other DNA
cattgatacaaattagccgg

SEQ ID NO: 677 - DNA, 20 bp, synthetic construct
  misc_feature 1..20: note = source = /note="Description of Artificial Sequence: Syntheticoligonucleotide"
  source 1..20: mol_type = other DNA
ggcaaatgatgaagaaactt

SEQ ID NO: 678 - DNA, 20 bp, synthetic construct
  misc_feature 1..20: note = source = /note="Description of Artificial Sequence: Syntheticoligonucleotide"
  source 1..20: mol_type = other DNA
gcaacattccggagcatcct

SEQ ID NO: 679 - DNA, 20 bp, synthetic construct
  misc_feature 1..20: note = source = /note="Description of Artificial Sequence: Syntheticoligonucleotide"
  source 1..20: mol_type = other DNA
cattgatacaaattagccgg

SEQ ID NO: 680 - DNA, 20 bp, synthetic construct
  misc_feature 1..20: note = source = /note="Description of Artificial Sequence: Syntheticoligonucleotide"
  source 1..20: mol_type = other DNA
ggcaaatgatgaagaaactt

SEQ ID NO: 681 - DNA, 20 bp, synthetic construct
  misc_feature 1..20: note = source = /note="Description of Artificial Sequence: Syntheticoligonucleotide"
  source 1..20: mol_type = other DNA
gcaacattccggagcatcct

SEQ ID NO: 682 - DNA, 20 bp, synthetic construct
  misc_feature 1..20: note = source = /note="Description of Artificial Sequence: Syntheticoligonucleotide"
  source 1..20: mol_type = other DNA
gaccacagccgcagcgtcat

SEQ ID NO: 683 - DNA, 20 bp, synthetic construct
  misc_feature 1..20: note = source = /note="Description of Artificial Sequence: Syntheticoligonucleotide"
  source 1..20: mol_type = other DNA
tcacctcagctggaccacag

SEQ ID NO: 684 - DNA, 20 bp, synthetic construct
  misc_feature 1..20: note = source = /note="Description of Artificial Sequence: Syntheticoligonucleotide"
  source 1..20: mol_type = other DNA
ggcccctcacctcagctgga

SEQ ID NO: 685 - DNA, 20 bp, synthetic construct
  misc_feature 1..20: note = source = /note="Description of Artificial Sequence: Syntheticoligonucleotide"
  source 1..20: mol_type = other DNA
caggttttgaaagtttaggt

SEQ ID NO: 686 - DNA, 20 bp, synthetic construct
  misc_feature 1..20: note = source = /note="Description of Artificial Sequence: Syntheticoligonucleotide"
  source 1..20: mol_type = other DNA
gtcgagaaaagctttgaaac

SEQ ID NO: 687 - DNA, 20 bp, synthetic construct
  misc_feature 1..20: note = source = /note="Description of Artificial Sequence: Syntheticoligonucleotide"
  source 1..20: mol_type = other DNA
aaagcttttctcgaccagct

SEQ ID NO: 688 - DNA, 20 bp, synthetic construct
  misc_feature 1..20: note = source = /note="Description of Artificial Sequence: Syntheticoligonucleotide"
  source 1..20: mol_type = other DNA
ttttctcgaccagcttgaca

SEQ ID NO: 689 - DNA, 20 bp, synthetic construct
  misc_feature 1..20: note = source = /note="Description of Artificial Sequence: Syntheticoligonucleotide"
  source 1..20: mol_type = other DNA
tccaatggaggcagcgaggc

SEQ ID NO: 690 - DNA, 20 bp, synthetic construct
  misc_feature 1..20: note = source = /note="Description of Artificial Sequence: Syntheticoligonucleotide"
  source 1..20: mol_type = other DNA
gggccataaagagtataaac

SEQ ID NO: 691 - DNA, 20 bp, synthetic construct
  misc_feature 1..20: note = source = /note="Description of Artificial Sequence: Syntheticoligonucleotide"
  source 1..20: mol_type = other DNA
aggcagctggattttggcct

SEQ ID NO: 692 - DNA, 20 bp, synthetic construct
  misc_feature 1..20: note = source = /note="Description of Artificial Sequence: Syntheticoligonucleotide"
  source 1..20: mol_type = other DNA
caatggtgcatcttggctca

SEQ ID NO: 693 - DNA, 20 bp, synthetic construct
  misc_feature 1..20: note = source = /note="Description of Artificial Sequence: Syntheticoligonucleotide"
  source 1..20: mol_type = other DNA
ttcctccacttcaacacctg

SEQ ID NO: 694 - DNA, 20 bp, synthetic construct
  misc_feature 1..20: note = source = /note="Description of Artificial Sequence: Syntheticoligonucleotide"
  source 1..20: mol_type = other DNA
agtcacatggttcacacggc

SEQ ID NO: 695 - DNA, 20 bp, synthetic construct
  misc_feature 1..20: note = source = /note="Description of Artificial Sequence: Syntheticoligonucleotide"
  source 1..20: mol_type = other DNA
ctgtgacaaagtcacatggt

SEQ ID NO: 696 - DNA, 20 bp, synthetic construct
  misc_feature 1..20: note = source = /note="Description of Artificial Sequence: Syntheticoligonucleotide"
  source 1..20: mol_type = other DNA
aaagaccagtccttgctgaa

SEQ ID NO: 697 - DNA, 20 bp, synthetic construct
  misc_feature 1..20: note = source = /note="Description of Artificial Sequence: Syntheticoligonucleotide"
  source 1..20: mol_type = other DNA
gagagagaattgaaaaagtg

SEQ ID NO: 698 - DNA, 20 bp, synthetic construct
  misc_feature 1..20: note = source = /note="Description of Artificial Sequence: Syntheticoligonucleotide"
  source 1..20: mol_type = other DNA
cattctctgctggatgacgt

SEQ ID NO: 699 - DNA, 20 bp, synthetic construct
  misc_feature 1..20: note = source = /note="Description of Artificial Sequence: Syntheticoligonucleotide"
  source 1..20: mol_type = other DNA
gtgtctgggtttcatccatc

SEQ ID NO: 700 - DNA, 20 bp, synthetic construct
  misc_feature 1..20: note = source = /note="Description of Artificial Sequence: Syntheticoligonucleotide"
  source 1..20: mol_type = other DNA
tgagtaaacctgaatctttg

SEQ ID NO: 701 - DNA, 20 bp, synthetic construct
  misc_feature 1..20: note = source = /note="Description of Artificial Sequence: Syntheticoligonucleotide"
  source 1..20: mol_type = other DNA
gcctccaggccagaaagaga

SEQ ID NO: 702 - DNA, 20 bp, synthetic construct
  misc_feature 1..20: note = source = /note="Description of Artificial Sequence: Syntheticoligonucleotide"
  source 1..20: mol_type = other DNA
ccagaaagagagagtagcgc

SEQ ID NO: 703 - DNA, 20 bp, synthetic construct
  misc_feature 1..20: note = source = /note="Description of Artificial Sequence: Syntheticoligonucleotide"
  source 1..20: mol_type = other DNA
agaaagagagagtagcgcga

SEQ ID NO: 704 - DNA, 20 bp, synthetic construct
  misc_feature 1..20: note = source = /note="Description of Artificial Sequence: Syntheticoligonucleotide"
  source 1..20: mol_type = other DNA
acagctaaggccacggagcg

SEQ ID NO: 705 - DNA, 20 bp, synthetic construct
  misc_feature 1..20: note = source = /note="Description of Artificial Sequence: Syntheticoligonucleotide"
  source 1..20: mol_type = other DNA
gggtaggagagactcacgct

SEQ ID NO: 706 - DNA, 20 bp, synthetic construct
  misc_feature 1..20: note = source = /note="Description of Artificial Sequence: Syntheticoligonucleotide"
  source 1..20: mol_type = other DNA
ggctgtggtgagccataatt

SEQ ID NO: 707 - DNA, 20 bp, synthetic construct
  misc_feature 1..20: note = source = /note="Description of Artificial Sequence: Syntheticoligonucleotide"
  source 1..20: mol_type = other DNA
gggttcgaggctgtggtgag

SEQ ID NO: 708 - DNA, 20 bp, synthetic construct
  misc_feature 1..20: note = source = /note="Description of Artificial Sequence: Syntheticoligonucleotide"
  source 1..20: mol_type = other DNA
actctcacttaccttcatta

SEQ ID NO: 709 - DNA, 20 bp, synthetic construct
  misc_feature 1..20: note = source = /note="Description of Artificial Sequence: Syntheticoligonucleotide"
  source 1..20: mol_type = other DNA
aaggaagaacagacccccca

SEQ ID NO: 710 - DNA, 20 bp, synthetic construct
  misc_feature 1..20: note = source = /note="Description of Artificial Sequence: Syntheticoligonucleotide"
  source 1..20: mol_type = other DNA
tttataatcttctaaaggaa

SEQ ID NO: 711 - DNA, 20 bp, synthetic construct
  misc_feature 1..20: note = source = /note="Description of Artificial Sequence: Syntheticoligonucleotide"
  source 1..20: mol_type = other DNA
actctaaaggatcagctgat

SEQ ID NO: 712 - DNA, 20 bp, synthetic construct
  misc_feature 1..20: note = source = /note="Description of Artificial Sequence: Syntheticoligonucleotide"
  source 1..20: mol_type = other DNA
ttttggttccaagtccaata

SEQ ID NO: 713 - DNA, 20 bp, synthetic construct
  misc_feature 1..20: note = source = /note="Description of Artificial Sequence: Syntheticoligonucleotide"
  source 1..20: mol_type = other DNA
gacttggaaccaaaaggaat

SEQ ID NO: 714 - DNA, 20 bp, synthetic construct
  misc_feature 1..20: note = source = /note="Description of Artificial Sequence: Syntheticoligonucleotide"
  source 1..20: mol_type = other DNA
gacactaaatgtttttcctc

SEQ ID NO: 715 - DNA, 20 bp, synthetic construct
  misc_feature 1..20: note = source = /note="Description of Artificial Sequence: Syntheticoligonucleotide"
  source 1..20: mol_type = other DNA
aaacattaaagaagctgtag

SEQ ID NO: 716 - DNA, 20 bp, synthetic construct
  misc_feature 1..20: note = source = /note="Description of Artificial Sequence: Syntheticoligonucleotide"
  source 1..20: mol_type = other DNA
gccgtagcccccacacatat

SEQ ID NO: 717 - DNA, 20 bp, synthetic construct
  misc_feature 1..20: note = source = /note="Description of Artificial Sequence: Syntheticoligonucleotide"
  source 1..20: mol_type = other DNA
gatgctccggaatgttgctg

SEQ ID NO: 718 - DNA, 20 bp, synthetic construct
  misc_feature 1..20: note = source = /note="Description of Artificial Sequence: Syntheticoligonucleotide"
  source 1..20: mol_type = other DNA
ttgatacaaattagccgggg

SEQ ID NO: 719 - DNA, 20 bp, synthetic construct
  misc_feature 1..20: note = source = /note="Description of Artificial Sequence: Syntheticoligonucleotide"
  source 1..20: mol_type = other DNA
ttgccccagacctgtaatag

SEQ ID NO: 720 - DNA, 20 bp, synthetic construct
  misc_feature 1..20: note = source = /note="Description of Artificial Sequence: Syntheticoligonucleotide"
  source 1..20: mol_type = other DNA
cttcatcatttgccccagac

SEQ ID NO: 721 - DNA, 20 bp, synthetic construct
  misc_feature 1..20: note = source = /note="Description of Artificial Sequence: Syntheticoligonucleotide"
  source 1..20: mol_type = other DNA
catcatttgccccagacctg

SEQ ID NO: 722 - DNA, 20 bp, synthetic construct
  misc_feature 1..20: note = source = /note="Description of Artificial Sequence: Syntheticoligonucleotide"
  source 1..20: mol_type = other DNA
cacagtggcaagctcgccgt

SEQ ID NO: 723 - DNA, 20 bp, synthetic construct
  misc_feature 1..20: note = source = /note="Description of Artificial Sequence: Syntheticoligonucleotide"
  source 1..20: mol_type = other DNA
ccgtccacatgagccatgcg

SEQ ID NO: 724 - DNA, 20 bp, synthetic construct
  misc_feature 1..20: note = source = /note="Description of Artificial Sequence: Syntheticoligonucleotide"
  source 1..20: mol_type = other DNA
atgagccatgcgctgcatgg

SEQ ID NO: 725 - DNA, 20 bp, synthetic construct
  misc_feature 1..20: note = source = /note="Description of Artificial Sequence: Syntheticoligonucleotide"
  source 1..20: mol_type = other DNA
ttatgaacaacatgctaaat

SEQ ID NO: 726 - DNA, 20 bp, synthetic construct
  misc_feature 1..20: note = source = /note="Description of Artificial Sequence: Syntheticoligonucleotide"
  source 1..20: mol_type = other DNA
cccagacctgtaatagtcat

SEQ ID NO: 727 - DNA, 20 bp, synthetic construct
  misc_feature 1..20: note = source = /note="Description of Artificial Sequence: Syntheticoligonucleotide"
  source 1..20: mol_type = other DNA
gagggtaggagagactcacg

SEQ ID NO: 728 - DNA, 20 bp, synthetic construct
  misc_feature 1..20: note = source = /note="Description of Artificial Sequence: Syntheticoligonucleotide"
  source 1..20: mol_type = other DNA
acggagcgagacatctcggc

SEQ ID NO: 729 - DNA, 20 bp, synthetic construct
  misc_feature 1..20: note = source = /note="Description of Artificial Sequence: Syntheticoligonucleotide"
  source 1..20: mol_type = other DNA
agcacagctaaggccacgga

SEQ ID NO: 730 - DNA, 20 bp, synthetic construct
  misc_feature 1..20: note = source = /note="Description of Artificial Sequence: Syntheticoligonucleotide"
  source 1..20: mol_type = other DNA
cgcgagcacagctaaggcca

SEQ ID NO: 731 - DNA, 20 bp, synthetic construct
  misc_feature 1..20: note = source = /note="Description of Artificial Sequence: Syntheticoligonucleotide"
  source 1..20: mol_type = other DNA
gcgcgagcacagctaaggcc

SEQ ID NO: 732 - DNA, 20 bp, synthetic construct
  misc_feature 1..20: note = source = /note="Description of Artificial Sequence: Syntheticoligonucleotide"
  source 1..20: mol_type = other DNA
cgctactctctctttctggc

SEQ ID NO: 733 - DNA, 20 bp, synthetic construct
  misc_feature 1..20: note = source = /note="Description of Artificial Sequence: Syntheticoligonucleotide"
  source 1..20: mol_type = other DNA
ggccagaaagagagagtagc

SEQ ID NO: 734 - DNA, 20 bp, synthetic construct
  misc_feature 1..20: note = source = /note="Description of Artificial Sequence: Syntheticoligonucleotide"
  source 1..20: mol_type = other DNA
gctactctctctttctggcc

SEQ ID NO: 735 - DNA, 20 bp, synthetic construct
  misc_feature 1..20: note = source = /note="Description of Artificial Sequence: Syntheticoligonucleotide"
  source 1..20: mol_type = other DNA
tagcctccaggccagaaaga

SEQ ID NO: 736 - DNA, 20 bp, synthetic construct
  misc_feature 1..20: note = source = /note="Description of Artificial Sequence: Syntheticoligonucleotide"
  source 1..20: mol_type = other DNA
tggatagcctccaggccaga

SEQ ID NO: 737 - DNA, 20 bp, synthetic construct
  misc_feature 1..20: note = source = /note="Description of Artificial Sequence: Syntheticoligonucleotide"
  source 1..20: mol_type = other DNA
tggcctggaggctatccagc

SEQ ID NO: 738 - DNA, 20 bp, synthetic construct
  misc_feature 1..20: note = source = /note="Description of Artificial Sequence: Syntheticoligonucleotide"
  source 1..20: mol_type = other DNA
acgctggatagcctccaggc

SEQ ID NO: 739 - DNA, 20 bp, synthetic construct
  misc_feature 1..20: note = source = /note="Description of Artificial Sequence: Syntheticoligonucleotide"
  source 1..20: mol_type = other DNA
gctaatttgtatcaatgatt

SEQ ID NO: 740 - DNA, 20 bp, synthetic construct
  misc_feature 1..20: note = source = /note="Description of Artificial Sequence: Syntheticoligonucleotide"
  source 1..20: mol_type = other DNA
taatagtcatatatagactt

SEQ ID NO: 741 - DNA, 20 bp, synthetic construct
  misc_feature 1..20: note = source = /note="Description of Artificial Sequence: Syntheticoligonucleotide"
  source 1..20: mol_type = other DNA
gtaatagtcatatatagact

SEQ ID NO: 742 - DNA, 20 bp, synthetic construct
  misc_feature 1..20: note = source = /note="Description of Artificial Sequence: Syntheticoligonucleotide"
  source 1..20: mol_type = other DNA
tatatatgactattacaggt

SEQ ID NO: 743 - DNA, 20 bp, synthetic construct
  misc_feature 1..20: note = source = /note="Description of Artificial Sequence: Syntheticoligonucleotide"
  source 1..20: mol_type = other DNA
ttacaggtctggggcaaatg

SEQ ID NO: 744 - DNA, 20 bp, synthetic construct
  misc_feature 1..20: note = source = /note="Description of Artificial Sequence: Syntheticoligonucleotide"
  source 1..20: mol_type = other DNA
caggtctggggcaaatgatg

SEQ ID NO: 745 - DNA, 20 bp, synthetic construct
  misc_feature 1..20: note = source = /note="Description of Artificial Sequence: Syntheticoligonucleotide"
  source 1..20: mol_type = other DNA
gggtcagcatgccaatatgt

SEQ ID NO: 746 - DNA, 20 bp, synthetic construct
  misc_feature 1..20: note = source = /note="Description of Artificial Sequence: Syntheticoligonucleotide"
  source 1..20: mol_type = other DNA
gcgcatggctcatgtggacg

SEQ ID NO: 747 - DNA, 20 bp, synthetic construct
  misc_feature 1..20: note = source = /note="Description of Artificial Sequence: Syntheticoligonucleotide"
  source 1..20: mol_type = other DNA
agctgtatccaaggatgctc

SEQ ID NO: 748 - DNA, 20 bp, synthetic construct
  misc_feature 1..20: note = source = /note="Description of Artificial Sequence: Syntheticoligonucleotide"
  source 1..20: mol_type = other DNA
agcaacattccggagcatcc

SEQ ID NO: 749 - DNA, 20 bp, synthetic construct
  misc_feature 1..20: note = source = /note="Description of Artificial Sequence: Syntheticoligonucleotide"
  source 1..20: mol_type = other DNA
ccatgcagcgcatggctcat

SEQ ID NO: 750 - DNA, 20 bp, synthetic construct
  misc_feature 1..20: note = source = /note="Description of Artificial Sequence: Syntheticoligonucleotide"
  source 1..20: mol_type = other DNA
gtggcaagctcgccgtccac

SEQ ID NO: 751 - DNA, 20 bp, synthetic construct
  misc_feature 1..20: note = source = /note="Description of Artificial Sequence: Syntheticoligonucleotide"
  source 1..20: mol_type = other DNA
tggaaccaaaaggaatctat

SEQ ID NO: 752 - DNA, 20 bp, synthetic construct
  misc_feature 1..20: note = source = /note="Description of Artificial Sequence: Syntheticoligonucleotide"
  source 1..20: mol_type = other DNA
atattggacttggaaccaaa

SEQ ID NO: 753 - DNA, 20 bp, synthetic construct
  misc_feature 1..20: note = source = /note="Description of Artificial Sequence: Syntheticoligonucleotide"
  source 1..20: mol_type = other DNA
agtccaatatggcaactcta

SEQ ID NO: 754 - DNA, 20 bp, synthetic construct
  misc_feature 1..20: note = source = /note="Description of Artificial Sequence: Syntheticoligonucleotide"
  source 1..20: mol_type = other DNA
tagagttgccatattggact

SEQ ID NO: 755 - DNA, 20 bp, synthetic construct
  misc_feature 1..20: note = source = /note="Description of Artificial Sequence: Syntheticoligonucleotide"
  source 1..20: mol_type = other DNA
ttagagttgccatattggac

SEQ ID NO: 756 - DNA, 20 bp, synthetic construct
  misc_feature 1..20: note = source = /note="Description of Artificial Sequence: Syntheticoligonucleotide"
  source 1..20: mol_type = other DNA
ttataaatcagctgatcctt

SEQ ID NO: 757 - DNA, 20 bp, synthetic construct
  misc_feature 1..20: note = source = /note="Description of Artificial Sequence: Syntheticoligonucleotide"
  source 1..20: mol_type = other DNA
gatttataatcttctaaagg

SEQ ID NO: 758 - DNA, 20 bp, synthetic construct
  misc_feature 1..20: note = source = /note="Description of Artificial Sequence: Syntheticoligonucleotide"
  source 1..20: mol_type = other DNA
ccagaataagattacagttg

SEQ ID NO: 759 - DNA, 20 bp, synthetic construct
  misc_feature 1..20: note = source = /note="Description of Artificial Sequence: Syntheticoligonucleotide"
  source 1..20: mol_type = other DNA
ccaacaactgtaatcttatt

SEQ ID NO: 760 - DNA, 20 bp, synthetic construct
  misc_feature 1..20: note = source = /note="Description of Artificial Sequence: Syntheticoligonucleotide"
  source 1..20: mol_type = other DNA
cctgtgccatcagtatctta

SEQ ID NO: 761 - DNA, 20 bp, synthetic construct
  misc_feature 1..20: note = source = /note="Description of Artificial Sequence: Syntheticoligonucleotide"
  source 1..20: mol_type = other DNA
gtaagtgagagtctaccaca

SEQ ID NO: 762 - DNA, 20 bp, synthetic construct
  misc_feature 1..20: note = source = /note="Description of Artificial Sequence: Syntheticoligonucleotide"
  source 1..20: mol_type = other DNA
taagtgagagtctaccacac

SEQ ID NO: 763 - DNA, 20 bp, synthetic construct
  misc_feature 1..20: note = source = /note="Description of Artificial Sequence: Syntheticoligonucleotide"
  source 1..20: mol_type = other DNA
cagacaaaactgtgctagac

SEQ ID NO: 764 - DNA, 20 bp, synthetic construct
  misc_feature 1..20: note = source = /note="Description of Artificial Sequence: Syntheticoligonucleotide"
  source 1..20: mol_type = other DNA
acatgaggtctatggacttc

SEQ ID NO: 765 - DNA, 20 bp, synthetic construct
  misc_feature 1..20: note = source = /note="Description of Artificial Sequence: Syntheticoligonucleotide"
  source 1..20: mol_type = other DNA
agagcaacagtgctgtggcc

SEQ ID NO: 766 - DNA, 20 bp, synthetic construct
  misc_feature 1..20: note = source = /note="Description of Artificial Sequence: Syntheticoligonucleotide"
  source 1..20: mol_type = other DNA
aggccacagcactgttgctc

SEQ ID NO: 767 - DNA, 20 bp, synthetic construct
  misc_feature 1..20: note = source = /note="Description of Artificial Sequence: Syntheticoligonucleotide"
  source 1..20: mol_type = other DNA
gctggggaagaaggtgtctt

SEQ ID NO: 768 - DNA, 20 bp, synthetic construct
  misc_feature 1..20: note = source = /note="Description of Artificial Sequence: Syntheticoligonucleotide"
  source 1..20: mol_type = other DNA
ccttcttccccagcccaggt

SEQ ID NO: 769 - DNA, 20 bp, synthetic construct
  misc_feature 1..20: note = source = /note="Description of Artificial Sequence: Syntheticoligonucleotide"
  source 1..20: mol_type = other DNA
ggcaccaaagctgcccttac

SEQ ID NO: 770 - DNA, 20 bp, synthetic construct
  misc_feature 1..20: note = source = /note="Description of Artificial Sequence: Syntheticoligonucleotide"
  source 1..20: mol_type = other DNA
tacacggcagggtcagggtt

SEQ ID NO: 771 - DNA, 20 bp, synthetic construct
  misc_feature 1..20: note = source = /note="Description of Artificial Sequence: Syntheticoligonucleotide"
  source 1..20: mol_type = other DNA
ctgaccctgccgtgtaccag

SEQ ID NO: 772 - DNA, 20 bp, synthetic construct
  misc_feature 1..20: note = source = /note="Description of Artificial Sequence: Syntheticoligonucleotide"
  source 1..20: mol_type = other DNA
cagctggtacacggcagggt

SEQ ID NO: 773 - DNA, 20 bp, synthetic construct
  misc_feature 1..20: note = source = /note="Description of Artificial Sequence: Syntheticoligonucleotide"
  source 1..20: mol_type = other DNA
gtctctcagctggtacacgg

SEQ ID NO: 774 - DNA, 20 bp, synthetic construct
  misc_feature 1..20: note = source = /note="Description of Artificial Sequence: Syntheticoligonucleotide"
  source 1..20: mol_type = other DNA
gacagacttgtcactggatt

SEQ ID NO: 775 - DNA, 20 bp, synthetic construct
  misc_feature 1..20: note = source = /note="Description of Artificial Sequence: Syntheticoligonucleotide"
  source 1..20: mol_type = other DNA
agagtctctcagctggtaca

SEQ ID NO: 776 - DNA, 20 bp, synthetic construct
  misc_feature 1..20: note = source = /note="Description of Artificial Sequence: Syntheticoligonucleotide"
  source 1..20: mol_type = other DNA
agagcaacagtgctgtggcc

SEQ ID NO: 777 - DNA, 20 bp, synthetic construct
  misc_feature 1..20: note = source = /note="Description of Artificial Sequence: Syntheticoligonucleotide"
  source 1..20: mol_type = other DNA
tcagggttctggatatctgt

SEQ ID NO: 778 - DNA, 20 bp, synthetic construct
  misc_feature 1..20: note = source = /note="Description of Artificial Sequence: Syntheticoligonucleotide"
  source 1..20: mol_type = other DNA
cttacctgggctggggaaga

SEQ ID NO: 779 - DNA, 20 bp, synthetic construct
  misc_feature 1..20: note = source = /note="Description of Artificial Sequence: Syntheticoligonucleotide"
  source 1..20: mol_type = other DNA
ttcgtatctgtaaaaccaag

SEQ ID NO: 780 - DNA, 20 bp, synthetic construct
  misc_feature 1..20: note = source = /note="Description of Artificial Sequence: Syntheticoligonucleotide"
  source 1..20: mol_type = other DNA
tttcaaaacctgtcagtgat

SEQ ID NO: 781 - DNA, 20 bp, synthetic construct
  misc_feature 1..20: note = source = /note="Description of Artificial Sequence: Syntheticoligonucleotide"
  source 1..20: mol_type = other DNA
ttcaaaacctgtcagtgatt

SEQ ID NO: 782 - DNA, 20 bp, synthetic construct
  misc_feature 1..20: note = source = /note="Description of Artificial Sequence: Syntheticoligonucleotide"
  source 1..20: mol_type = other DNA
gctggtacacggcagggtca

SEQ ID NO: 783 - DNA, 20 bp, synthetic construct
  misc_feature 1..20: note = source = /note="Description of Artificial Sequence: Syntheticoligonucleotide"
  source 1..20: mol_type = other DNA
gtggcgcattgccacgaagc

SEQ ID NO: 784 - DNA, 20 bp, synthetic construct
  misc_feature 1..20: note = source = /note="Description of Artificial Sequence: Syntheticoligonucleotide"
  source 1..20: mol_type = other DNA
ttcttcttctgctcggactc

SEQ ID NO: 785 - DNA, 20 bp, synthetic construct
  misc_feature 1..20: note = source = /note="Description of Artificial Sequence: Syntheticoligonucleotide"
  source 1..20: mol_type = other DNA
accggaggacaaagtacaaa

SEQ ID NO: 786 - DNA, 19 bp, synthetic construct
  misc_feature 1..19: note = source = /note="Description of Artificial Sequence: Syntheticoligonucleotide"
  source 1..19: mol_type = other DNA
gagcccttcttcttctgct

SEQ ID NO: 787 - DNA, 19 bp, synthetic construct
  misc_feature 1..19: note = source = /note="Description of Artificial Sequence: Syntheticoligonucleotide"
  source 1..19: mol_type = other DNA
cgccaccggttgatgtgat

SEQ ID NO: 788 - DNA, 20 bp, synthetic construct
  misc_feature 1..20: note = source = /note="Description of Artificial Sequence: Syntheticoligonucleotide"
  source 1..20: mol_type = other DNA
gtcacctccaatgactaggg

SEQ ID NO: 789 - DNA, 20 bp, synthetic construct
  misc_feature 1..20: note = source = /note="Description of Artificial Sequence: Syntheticoligonucleotide"
  source 1..20: mol_type = other DNA
gacatcgatgtcctccccat

SEQ ID NO: 790 - DNA, 20 bp, synthetic construct
  misc_feature 1..20: note = source = /note="Description of Artificial Sequence: Syntheticoligonucleotide"
  source 1..20: mol_type = other DNA
agtctatatatgactattac

SEQ ID NO: 791 - DNA, 20 bp, synthetic construct
  misc_feature 1..20: note = source = /note="Description of Artificial Sequence: Syntheticoligonucleotide"
  source 1..20: mol_type = other DNA
tcagctgggaagatatcaaa

SEQ ID NO: 792 - DNA, 20 bp, synthetic construct
  misc_feature 1..20: note = source = /note="Description of Artificial Sequence: Syntheticoligonucleotide"
  source 1..20: mol_type = other DNA
aatagacccatctatcagct

SEQ ID NO: 793 - DNA, 20 bp, synthetic construct
  misc_feature 1..20: note = source = /note="Description of Artificial Sequence: Syntheticoligonucleotide"
  source 1..20: mol_type = other DNA
aatcattgatacaaattagc

SEQ ID NO: 794 - DNA, 20 bp, synthetic construct
  misc_feature 1..20: note = source = /note="Description of Artificial Sequence: Syntheticoligonucleotide"
  source 1..20: mol_type = other DNA
atcattgatacaaattagcc

SEQ ID NO: 795 - DNA, 20 bp, synthetic construct
  misc_feature 1..20: note = source = /note="Description of Artificial Sequence: Syntheticoligonucleotide"
  source 1..20: mol_type = other DNA
cagtggacttgctgcatatg

SEQ ID NO: 796 - DNA, 20 bp, synthetic construct
  misc_feature 1..20: note = source = /note="Description of Artificial Sequence: Syntheticoligonucleotide"
  source 1..20: mol_type = other DNA
cactgatgttctgaaagctc

SEQ ID NO: 797 - DNA, 20 bp, synthetic construct
  misc_feature 1..20: note = source = /note="Description of Artificial Sequence: Syntheticoligonucleotide"
  source 1..20: mol_type = other DNA
ctttccgcacacccccgtcc

SEQ ID NO: 798 - DNA, 20 bp, synthetic construct
  misc_feature 1..20: note = source = /note="Description of Artificial Sequence: Syntheticoligonucleotide"
  source 1..20: mol_type = other DNA
atatgactattacaggtctg

SEQ ID NO: 799 - DNA, 20 bp, synthetic construct
  misc_feature 1..20: note = source = /note="Description of Artificial Sequence: Syntheticoligonucleotide"
  source 1..20: mol_type = other DNA
gagatgatggatctccaaca

SEQ ID NO: 800 - DNA, 20 bp, synthetic construct
  misc_feature 1..20: note = source = /note="Description of Artificial Sequence: Syntheticoligonucleotide"
  source 1..20: mol_type = other DNA
tatttcttttagtgcctgta

SEQ ID NO: 801 - DNA, 20 bp, synthetic construct
  misc_feature 1..20: note = source = /note="Description of Artificial Sequence: Syntheticoligonucleotide"
  source 1..20: mol_type = other DNA
agactctgcacccagattta

SEQ ID NO: 802 - DNA, 20 bp, synthetic construct
  misc_feature 1..20: note = source = /note="Description of Artificial Sequence: Syntheticoligonucleotide"
  source 1..20: mol_type = other DNA
ctttatcagtccctaaatct

SEQ ID NO: 803 - DNA, 20 bp, synthetic construct
  misc_feature 1..20: note = source = /note="Description of Artificial Sequence: Syntheticoligonucleotide"
  source 1..20: mol_type = other DNA
tttagggactgataaagata

SEQ ID NO: 804 - DNA, 20 bp, synthetic construct
  misc_feature 1..20: note = source = /note="Description of Artificial Sequence: Syntheticoligonucleotide"
  source 1..20: mol_type = other DNA
gctggtcattatcacggctg

SEQ ID NO: 805 - DNA, 20 bp, synthetic construct
  misc_feature 1..20: note = source = /note="Description of Artificial Sequence: Syntheticoligonucleotide"
  source 1..20: mol_type = other DNA
cctatcatacagtgcttatg

SEQ ID NO: 806 - DNA, 20 bp, synthetic construct
  misc_feature 1..20: note = source = /note="Description of Artificial Sequence: Syntheticoligonucleotide"
  source 1..20: mol_type = other DNA
tacagagagtccaatagccc

SEQ ID NO: 807 - DNA, 20 bp, synthetic construct
  misc_feature 1..20: note = source = /note="Description of Artificial Sequence: Syntheticoligonucleotide"
  source 1..20: mol_type = other DNA
ccttaatcatggtggaaact

SEQ ID NO: 808 - DNA, 20 bp, synthetic construct
  misc_feature 1..20: note = source = /note="Description of Artificial Sequence: Syntheticoligonucleotide"
  source 1..20: mol_type = other DNA
tagacctaccttaatcatgg

SEQ ID NO: 809 - DNA, 20 bp, synthetic construct
  misc_feature 1..20: note = source = /note="Description of Artificial Sequence: Syntheticoligonucleotide"
  source 1..20: mol_type = other DNA
acatagacctaccttaatca

SEQ ID NO: 810 - DNA, 20 bp, synthetic construct
  misc_feature 1..20: note = source = /note="Description of Artificial Sequence: Syntheticoligonucleotide"
  source 1..20: mol_type = other DNA
gggtggggggagtttgctcc

SEQ ID NO: 811 - DNA, 164 bp, synthetic construct
  misc_feature 1..164: note = source = /note="Description of Artificial Sequence: Syntheticpolynucleotide"
  source 1..164: mol_type = other DNA
gttttaatggcccagcctcacacccgccataattcctctgtaaaacttaaagaaggtttatagagttattatggtaaggcaatatgccgtggcgttggggatcgcctatgtccggttttaccggatctccctaaaggtgactaactttggttagtcaccttttt

SEQ ID NO: 812 - DNA, 110 bp, synthetic construct
  misc_feature 1..110: note = source = /note="Description of Artificial Sequence: Syntheticpolynucleotide"
  source 1..110: mol_type = other DNA
accggaggacaaagtacaaagttattgtactctcaataaaaagttattgagaatctacaataataaggcatcttgccgaatttaccgccctacatatgtagggcggtttt

SEQ ID NO: 813 - DNA, 110 bp, synthetic construct
  misc_feature 1..110: note = source = /note="Description of Artificial Sequence: Syntheticpolynucleotide"
  source 1..110: mol_type = other DNA
tggatttagagtctctcagcgttattgtactctcaataaaaagttattgagaatctacaataataaggcatcttgccgaatttaccgccctacatatgtagggcggtttt

SEQ ID NO: 814 - DNA, 110 bp, synthetic construct; identical to SEQ ID NO: 557
  misc_feature 1..110: note = source = /note="Description of Artificial Sequence: Syntheticpolynucleotide"
  source 1..110: mol_type = other DNA

SEQ ID NO: 815 - DNA, 110 bp, synthetic construct; identical to SEQ ID NO: 558
  misc_feature 1..110: note = source = /note="Description of Artificial Sequence: Syntheticpolynucleotide"
  source 1..110: mol_type = other DNA

SEQ ID NO: 816 - DNA, 110 bp, synthetic construct; identical to SEQ ID NO: 559
  misc_feature 1..110: note = source = /note="Description of Artificial Sequence: Syntheticpolynucleotide"
  source 1..110: mol_type = other DNA

SEQ ID NO: 817 - DNA, 110 bp, synthetic construct; identical to SEQ ID NO: 560
  misc_feature 1..110: note = source = /note="Description of Artificial Sequence: Syntheticpolynucleotide"
  source 1..110: mol_type = other DNA

SEQ ID NO: 818 - DNA, 110 bp, synthetic construct
  misc_feature 1..110: note = source = /note="Description of Artificial Sequence: Syntheticpolynucleotide"
  source 1..110: mol_type = other DNA
gtcagaaatagggggtccaggttattgtactctcaataaaaagttattgagaatctacaataataaggcatcttgccgaatttaccgccctacatatgtagggcggtttt

SEQ ID NO: 819 - DNA, 137 bp, synthetic construct
  misc_feature 1..137: note = source = /note="Description of Artificial Sequence: Syntheticpolynucleotide"
  source 1..137: mol_type = other DNA
cctgaatgctgtgcggctctgccataattcctcaaaggagttattatggtaaggcaatatgccgtggcgttggggatcgcctatgtccggttttaccggatctccctagaggtgactaactttggttagtcgccttt

SEQ ID NO: 820 - DNA, 105 bp, synthetic construct
  misc_feature 1..105: note = source = /note="Description of Artificial Sequence: Syntheticpolynucleotide"
  source 1..105: mol_type = other DNA
cgaccccctccaccccgcctgttttagtactctgtaaaaagttacagaatctactaaaacaaggcaaaatgccgtgtttatctcgtcaacttgttggcgagattt

SEQ ID NO: 821 - DNA, 105 bp, synthetic construct
  misc_feature 1..105: note = source = /note="Description of Artificial Sequence: Syntheticpolynucleotide"
  source 1..105: mol_type = other DNA
ggggtggggggagtttgctcgttttagtactctgtaaaaagttacagaatctactaaaacaaggcaaaatgccgtgtttatctcgtcaacttgttggcgagattt

SEQ ID NO: 822 - DNA, 105 bp, synthetic construct
  misc_feature 1..105: note = source = /note="Description of Artificial Sequence: Syntheticpolynucleotide"
  source 1..105: mol_type = other DNA
aggtcagaaatagggggtccgttttagtactctgtaaaaagttacagaatctactaaaacaaggcaaaatgccgtgtttatctcgtcaacttgttggcgagattt

SEQ ID NO: 823 - DNA, 105 bp, synthetic construct
  misc_feature 1..105: note = source = /note="Description of Artificial Sequence: Syntheticpolynucleotide"
  source 1..105: mol_type = other DNA
tgagaaaggacaggcggcaggttttagtactctgtaaaaagttacagaatctactaaaacaaggcaaaatgccgtgtttatctcgtcaacttgttggcgagattt

SEQ ID NO: 824 - DNA, 105 bp, synthetic construct
  misc_feature 1..105: note = source = /note="Description of Artificial Sequence: Syntheticpolynucleotide"
  source 1..105: mol_type = other DNA
ctctgcttccaggtgacagtgttttagtactctgtaaaaagttacagaatctactaaaacaaggcaaaatgccgtgtttatctcgtcaacttgttggcgagattt

SEQ ID NO: 825 - DNA, 105 bp, synthetic construct
  misc_feature 1..105: note = source = /note="Description of Artificial Sequence: Syntheticpolynucleotide"
  source 1..105: mol_type = other DNA
tgcgcatctccctggtcaccgttttagtactctgtaaaaagttacagaatctactaaaacaaggcaaaatgccgtgtttatctcgtcaacttgttggcgagattt

SEQ ID NO: 826 - DNA, 105 bp, synthetic construct
  misc_feature 1..105: note = source = /note="Description of Artificial Sequence: Syntheticpolynucleotide"
  source 1..105: mol_type = other DNA
aaaatctgctcttagggctcgttttagtactctgtaaaaagttacagaatctactaaaacaaggcaaaatgccgtgtttatctcgtcaacttgttggcgagattt

SEQ ID NO: 827 - DNA, 105 bp, synthetic construct
  misc_feature 1..105: note = source = /note="Description of Artificial Sequence: Syntheticpolynucleotide"
  source 1..105: mol_type = other DNA
gatgctctaatgtactgccagttttagtactctgtaaaaagttacagaatctactaaaacaaggcaaaatgccgtgtttatctcgtcaacttgttggcgagattt

SEQ ID NO: 828 - DNA, 105 bp, synthetic construct
  misc_feature 1..105: note = source = /note="Description of Artificial Sequence: Syntheticpolynucleotide"
  source 1..105: mol_type = other DNA
ctgggccattaaaacctctcgttttagtactctgtaaaaagttacagaatctactaaaacaaggcaaaatgccgtgtttatctcgtcaacttgttggcgagattt

SEQ ID NO: 829 - DNA, 114 bp, synthetic construct
  misc_feature 1..114: note = source = /note="Description of Artificial Sequence: Syntheticpolynucleotide"
  source 1..114: mol_type = other DNA
cctcacccccacgagcttgtaggaagttttagagtcatgttgaaagcaacatagcaagttaaaataaggttttaaccgtaatcaactgtaaagtggcgctgtttcggcgctttt

SEQ ID NO: 830 - DNA, 114 bp, synthetic construct
  misc_feature 1..114: note = source = /note="Description of Artificial Sequence: Syntheticpolynucleotide"
  source 1..114: mol_type = other DNA
atccagtgtgtgaagaagcgggaccgttttagagtcatgttgaaagcaacatagcaagttaaaataaggttttaaccgtaatcaactgtaaagtggcgctgtttcggcgctttt

SEQ ID NO: 831 - DNA, 114 bp, synthetic construct
  misc_feature 1..114: note = source = /note="Description of Artificial Sequence: Syntheticpolynucleotide"
  source 1..114: mol_type = other DNA
acagtgcgcatctccctggtcaccagttttagagtcatgttgaaagcaacatagcaagttaaaataaggttttaaccgtaatcaactgtaaagtggcgctgtttcggcgctttt

SEQ ID NO: 832 - DNA, 114 bp, synthetic construct
  misc_feature 1..114: note = source = /note="Description of Artificial Sequence: Syntheticpolynucleotide"
  source 1..114: mol_type = other DNA
cctcacccccacgagcttgtaggaagttttagagctatgcaaaggcatagcaagttaaaataaggctttgtccgtcatcagcttttttaaagcagcgctgttctcggcgctttt

SEQ ID NO: 833 - DNA, 114 bp, synthetic construct
  misc_feature 1..114: note = source = /note="Description of Artificial Sequence: Syntheticpolynucleotide"
  source 1..114: mol_type = other DNA
atccagtgtgtgaagaagcgggaccgttttagagctatgcaaaggcatagcaagttaaaataaggctttgtccgtcatcagcttttttaaagcagcgctgttctcggcgctttt

SEQ ID NO: 834 - DNA, 114 bp, synthetic construct
  misc_feature 1..114: note = source = /note="Description of Artificial Sequence: Syntheticpolynucleotide"
  source 1..114: mol_type = other DNA
acagtgcgcatctccctggtcaccagttttagagctatgcaaaggcatagcaagttaaaataaggctttgtccgtcatcagcttttttaaagcagcgctgttctcggcgctttt

SEQ ID NO: 835 - DNA, 110 bp, synthetic construct
  misc_feature 1..110: note = source = /note="Description of Artificial Sequence: Syntheticpolynucleotide"
  source 1..110: mol_type = other DNA
cctcacccccacgagcttgtaggaagttttagagctatgcaaaggcatagcaagttaaaataaggcttagtccgtaaacaaactttggcactgtattcggtgcttttttt

SEQ ID NO: 836 - DNA, 110 bp, synthetic construct
  misc_feature 1..110: note = source = /note="Description of Artificial Sequence: Syntheticpolynucleotide"
  source 1..110: mol_type = other DNA
atccagtgtgtgaagaagcgggaccgttttagagctatgcaaaggcatagcaagttaaaataaggcttagtccgtaaacaaactttggcactgtattcggtgcttttttt

SEQ ID NO: 837 - DNA, 110 bp, synthetic construct
  misc_feature 1..110: note = source = /note="Description of Artificial Sequence: Syntheticpolynucleotide"
  source 1..110: mol_type = other DNA
acagtgcgcatctccctggtcaccagttttagagctatgcaaaggcatagcaagttaaaataaggcttagtccgtaaacaaactttggcactgtattcggtgcttttttt

SEQ ID NO: 838 - DNA, 116 bp, synthetic construct
  misc_feature 1..116: note = source = /note="Description of Artificial Sequence: Syntheticpolynucleotide"
  source 1..116: mol_type = other DNA
atcccatctttgacaatcgtgttttagtgtcatgttgaatagaaagctattcaacatggcaagttaaaataagctttatgcgtattcaaacttttgttaaggcgacatcgcctttt

SEQ ID NO: 839 - DNA, 149 bp, synthetic construct
  misc_feature 1..149: note = source = /note="Description of Artificial Sequence: Syntheticpolynucleotide"
  source 1..149: mol_type = other DNA
cgattgtcaaagatgggatggtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 840 - DNA, 108 bp, synthetic construct
  misc_feature 1..108: note = source = /note="Description of Artificial Sequence: Syntheticpolynucleotide"
  source 1..108: mol_type = other DNA
acgattgtcaaagatgggatgtatttgtactctcaaaaagttgcagagcctacaaatataaggcttcatgccgaattcaagcaccccatgtttacatggggtgctttt

SEQ ID NO: 841 - DNA, 116 bp, synthetic construct
  misc_feature 1..116: note = source = /note="Description of Artificial Sequence: Syntheticpolynucleotide"
  source 1..116: mol_type = other DNA
tgtagccattgatctgtccagttttagtgtcatgttgaatagaaagctattcaacatggcaagttaaaataagctttatgcgtattcaaacttttgttaaggcgacatcgcctttt

SEQ ID NO: 842 - DNA, 149 bp, synthetic construct
  misc_feature 1..149: note = source = /note="Description of Artificial Sequence: Syntheticpolynucleotide"
  source 1..149: mol_type = other DNA
ctgtgtagccattgatctgtgtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 843 - DNA, 108 bp, synthetic construct
  misc_feature 1..108: note = source = /note="Description of Artificial Sequence: Syntheticpolynucleotide"
  source 1..108: mol_type = other DNA
cctgtgtagccattgatctggtatttgtactctcaaaaagttgcagagcctacaaatataaggcttcatgccgaattcaagcaccccatgtttacatggggtgctttt

SEQ ID NO: 844 - DNA, 149 bp, synthetic construct
  misc_feature 1..149: note = source = /note="Description of Artificial Sequence: Syntheticpolynucleotide"
  source 1..149: mol_type = other DNA
cagacatccaaacctgactcgtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 845 - DNA, 108 bp, synthetic construct
  misc_feature 1..108: note = source = /note="Description of Artificial Sequence: Syntheticpolynucleotide"
  source 1..108: mol_type = other DNA
ccagacatccaaacctgactgtatttgtactctcaaaaagttgcagagcctacaaatataaggcttcatgccgaattcaagcaccccatgtttacatggggtgctttt

SEQ ID NO: 846 - DNA, 116 bp, synthetic construct
  misc_feature 1..116: note = source = /note="Description of Artificial Sequence: Syntheticpolynucleotide"
  source 1..116: mol_type = other DNA
ccccagccctctgtgtttgggttttagtgtcatgttgaatagaaagctattcaacatggcaagttaaaataagctttatgcgtattcaaacttttgttaaggcgacatcgcctttt

SEQ ID NO: 847 - DNA, 108 bp, synthetic construct
  misc_feature 1..108: note = source = /note="Description of Artificial Sequence: Syntheticpolynucleotide"
  source 1..108: mol_type = other DNA
ttcaccgattttgattctcagtatttgtactctcaaaaagttgcagagcctacaaatataaggcttcatgccgaattcaagcaccccatgtttacatggggtgctttt

SEQ ID NO: 848 - DNA, 108 bp, synthetic construct
  misc_feature 1..108: note = source = /note="Description of Artificial Sequence: Syntheticpolynucleotide"
  source 1..108: mol_type = other DNA
acagtgctgtggcctggagcgtatttgtactctcaaaaagttgcagagcctacaaatataaggcttcatgccgaattcaagcaccccatgtttacatggggtgctttt

SEQ ID NO: 849 - DNA, 108 bp, synthetic construct
  misc_feature 1..108: note = source = /note="Description of Artificial Sequence: Syntheticpolynucleotide"
  source 1..108: mol_type = other DNA
ccgtgtaccagctgagagacgtatttgtactctcaaaaagttgcagagcctacaaatataaggcttcatgccgaattcaagcaccccatgtttacatggggtgctttt

SEQ ID NO: 850 - DNA, 149 bp, synthetic construct
  misc_feature 1..149: note = source = /note="Description of Artificial Sequence: Syntheticpolynucleotide"
  source 1..149: mol_type = other DNA
cagtgctgtggcctggagcagtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 851 - DNA, 149 bp, synthetic construct
  misc_feature 1..149: note = source = /note="Description of Artificial Sequence: Syntheticpolynucleotide"
  source 1..149: mol_type = other DNA
cgtgtaccagctgagagactgtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 852 - DNA, 149 bp, synthetic construct
  misc_feature 1..149: note = source = /note="Description of Artificial Sequence: Syntheticpolynucleotide"
  source 1..149: mol_type = other DNA
ctattcaccgattttgattcgtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 853 - DNA, 116 bp, synthetic construct
  misc_feature 1..116: note = source = /note="Description of Artificial Sequence: Syntheticpolynucleotide"
  source 1..116: mol_type = other DNA
catagacctcatgtctagcagttttagtgtcatgttgaatagaaagctattcaacatggcaagttaaaataagctttatgcgtattcaaacttttgttaaggcgacatcgcctttt

SEQ ID NO: 854 - DNA, 116 bp, synthetic construct
  misc_feature 1..116: note = source = /note="Description of Artificial Sequence: Syntheticpolynucleotide"
  source 1..116: mol_type = other DNA
tatctgtgggacaagaggatgttttagtgtcatgttgaatagaaagctattcaacatggcaagttaaaataagctttatgcgtattcaaacttttgttaaggcgacatcgcctttt

SEQ ID NO: 855 - DNA, 116 bp, synthetic construct
  misc_feature 1..116: note = source = /note="Description of Artificial Sequence: Syntheticpolynucleotide"
  source 1..116: mol_type = other DNA
gtctctcagctggtacacgggttttagtgtcatgttgaatagaaagctattcaacatggcaagttaaaataagctttatgcgtattcaaacttttgttaaggcgacatcgcctttt

SEQ ID NO: 856 - DNA, 109 bp, synthetic construct
  misc_feature 1..109: note = source = /note="Description of Artificial Sequence: Syntheticpolynucleotide"
  source 1..109: mol_type = other DNA
tgtgctagacatgaggtctagttttagagtcatgttgaaagcaacatagcaagttaaaataaggttttaaccgtaatcaactgtaaagtggcgctgtttcggcgctttt

SEQ ID NO: 857 - DNA, 109 bp, synthetic construct
  misc_feature 1..109: note = source = /note="Description of Artificial Sequence: Syntheticpolynucleotide"
  source 1..109: mol_type = other DNA
tctgtgggacaagaggatcagttttagagtcatgttgaaagcaacatagcaagttaaaataaggttttaaccgtaatcaactgtaaagtggcgctgtttcggcgctttt

SEQ ID NO: 858 - DNA, 109 bp, synthetic construct
  misc_feature 1..109: note = source = /note="Description of Artificial Sequence: Syntheticpolynucleotide"
  source 1..109: mol_type = other DNA
ctctcagctggtacacggcagttttagagtcatgttgaaagcaacatagcaagttaaaataaggttttaaccgtaatcaactgtaaagtggcgctgtttcggcgctttt

SEQ ID NO: 859 - DNA, 109 bp, synthetic construct
  misc_feature 1..109: note = source = /note="Description of Artificial Sequence: Syntheticpolynucleotide"
  source 1..109: mol_type = other DNA
tgtgctagacatgaggtctagttttagagctatgcaaaggcatagcaagttaaaataaggctttgtccgtcatcagcttttttaaagcagcgctgttctcggcgctttt

SEQ ID NO: 860 - DNA, 109 bp, synthetic construct
  misc_feature 1..109: note = source = /note="Description of Artificial Sequence: Syntheticpolynucleotide"
  source 1..109: mol_type = other DNA
tctgtgggacaagaggatcagttttagagctatgcaaaggcatagcaagttaaaataaggctttgtccgtcatcagcttttttaaagcagcgctgttctcggcgctttt

SEQ ID NO: 861 - DNA, 109 bp, synthetic construct
  misc_feature 1..109: note = source = /note="Description of Artificial Sequence: Syntheticpolynucleotide"
  source 1..109: mol_type = other DNA
ctctcagctggtacacggcagttttagagctatgcaaaggcatagcaagttaaaataaggctttgtccgtcatcagcttttttaaagcagcgctgttctcggcgctttt

SEQ ID NO: 862 - DNA, 109 bp, synthetic construct; identical to SEQ ID NO: 861
  misc_feature 1..109: note = source = /note="Description of Artificial Sequence: Syntheticpolynucleotide"
  source 1..109: mol_type = other DNA

SEQ ID NO: 863 - DNA, 105 bp, synthetic construct
  misc_feature 1..105: note = source = /note="Description of Artificial Sequence: Syntheticpolynucleotide"
  source 1..105: mol_type = other DNA
tgtgctagacatgaggtctagttttagagctatgcaaaggcatagcaagttaaaataaggcttagtccgtaaacaaactttggcactgtattcggtgcttttttt

SEQ ID NO: 864 - DNA, 105 bp, synthetic construct
  misc_feature 1..105: note = source = /note="Description of Artificial Sequence: Syntheticpolynucleotide"
  source 1..105: mol_type = other DNA
tctgtgggacaagaggatcagttttagagctatgcaaaggcatagcaagttaaaataaggcttagtccgtaaacaaactttggcactgtattcggtgcttttttt

SEQ ID NO: 865 - DNA, 105 bp, synthetic construct
  misc_feature 1..105: note = source = /note="Description of Artificial Sequence: Syntheticpolynucleotide"
  source 1..105: mol_type = other DNA
ctctcagctggtacacggcagttttagagctatgcaaaggcatagcaagttaaaataaggcttagtccgtaaacaaactttggcactgtattcggtgcttttttt

SEQ ID NO: 866 - DNA, 108 bp, synthetic construct
  misc_feature 1..108: note = source = /note="Description of Artificial Sequence: Syntheticpolynucleotide"
  source 1..108: mol_type = other DNA
atgttgttcataatcattgagtatttgtactctcaaaaagttgcagagcctacaaatataaggcttcatgccgaattcaagcaccccatgtttacatggggtgctttt

SEQ ID NO: 867 - DNA, 108 bp, synthetic construct
  misc_feature 1..108: note = source = /note="Description of Artificial Sequence: Syntheticpolynucleotide"
  source 1..108: mol_type = other DNA
tcaatgattatgaacaacatgtatttgtactctcaaaaagttgcagagcctacaaatataaggcttcatgccgaattcaagcaccccatgtttacatggggtgctttt

SEQ ID NO: 868 - DNA, 108 bp, synthetic construct
  misc_feature 1..108: note = source = /note="Description of Artificial Sequence: Syntheticpolynucleotide"
  source 1..108: mol_type = other DNA
caggtctggggcaaatgatggtatttgtactctcaaaaagttgcagagcctacaaatataaggcttcatgccgaattcaagcaccccatgtttacatggggtgctttt

SEQ ID NO: 869 - DNA, 149 bp, synthetic construct
  misc_feature 1..149: note = source = /note="Description of Artificial Sequence: Syntheticpolynucleotide"
  source 1..149: mol_type = other DNA
caatgattatgaacaacatggtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 870 - DNA, 149 bp, synthetic construct
  misc_feature 1..149: note = source = /note="Description of Artificial Sequence: Syntheticpolynucleotide"
  source 1..149: mol_type = other DNA
aggtctggggcaaatgatgagtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 871 - DNA, 149 bp, synthetic construct
  misc_feature 1..149: note = source = /note="Description of Artificial Sequence: Syntheticpolynucleotide"
  source 1..149: mol_type = other DNA
aggatgctccggaatgttgcgtttcagaagagtgaaagcattctgttttgaaatcaaacaacgctttacgcggagtttacacatctgtcccattatatgggcattacataataaaagaggaatcacctttaaggttgattcctcttttt

SEQ ID NO: 872 - DNA, 116 bp, synthetic construct
  misc_feature 1..116: note = source = /note="Description of Artificial Sequence: Syntheticpolynucleotide"
  source 1..116: mol_type = other DNA
ttgatacaaattagccgggggttttagtgtcatgttgaatagaaagctattcaacatggcaagttaaaataagctttatgcgtattcaaacttttgttaaggcgacatcgcctttt

SEQ ID NO: 873 - DNA, 116 bp, synthetic construct
  misc_feature 1..116: note = source = /note="Description of Artificial Sequence: Syntheticpolynucleotide"
  source 1..116: mol_type = other DNA
caggtctggggcaaatgatggttttagtgtcatgttgaatagaaagctattcaacatggcaagttaaaataagctttatgcgtattcaaacttttgttaaggcgacatcgcctttt

SEQ ID NO: 874 - DNA, 116 bp, synthetic construct
  misc_feature 1..116: note = source = /note="Description of Artificial Sequence: Syntheticpolynucleotide"
  source 1..116: mol_type = other DNA
gctccggaatgttgctgaaagttttagtgtcatgttgaatagaaagctattcaacatggcaagttaaaataagctttatgcgtattcaaacttttgttaaggcgacatcgcctttt

SEQ ID NO: 875 - DNA, 109 bp, synthetic construct
  misc_feature 1..109: note = source = /note="Description of Artificial Sequence: Syntheticpolynucleotide"
  source 1..109: mol_type = other DNA
cattgatacaaattagccgggttttagagtcatgttgaaagcaacatagcaagttaaaataaggttttaaccgtaatcaactgtaaagtggcgctgtttcggcgctttt

SEQ ID NO: 876 - DNA, 109 bp, synthetic construct
  misc_feature 1..109: note = source = /note="Description of Artificial Sequence: Syntheticpolynucleotide"
  source 1..109: mol_type = other DNA
ggcaaatgatgaagaaacttgttttagagtcatgttgaaagcaacatagcaagttaaaataaggttttaaccgtaatcaactgtaaagtggcgctgtttcggcgctttt

SEQ ID NO: 877 - DNA, 109 bp, synthetic construct
  misc_feature 1..109: note = source = /note="Description of Artificial Sequence: Syntheticpolynucleotide"
  source 1..109: mol_type = other DNA
gcaacattccggagcatcctgttttagagtcatgttgaaagcaacatagcaagttaaaataaggttttaaccgtaatcaactgtaaagtggcgctgtttcggcgctttt

SEQ ID NO: 878 - DNA, 109 bp, synthetic construct
  misc_feature 1..109: note = source = /note="Description of Artificial Sequence: Syntheticpolynucleotide"
  source 1..109: mol_type = other DNA
cattgatacaaattagccgggttttagagctatgcaaaggcatagcaagttaaaataaggctttgtccgtcatcagcttttttaaagcagcgctgttctcggcgctttt

SEQ ID NO: 879 - DNA, 109 bp, synthetic construct
  misc_feature 1..109: note = source = /note="Description of Artificial Sequence: Syntheticpolynucleotide"
  source 1..109: mol_type = other DNA
ggcaaatgatgaagaaacttgttttagagctatgcaaaggcatagcaagttaaaataaggctttgtccgtcatcagcttttttaaagcagcgctgttctcggcgctttt

SEQ ID NO: 880 - DNA, 109 bp, synthetic construct
  misc_feature 1..109: note = source = /note="Description of Artificial Sequence: Syntheticpolynucleotide"
  source 1..109: mol_type = other DNA
gcaacattccggagcatcctgttttagagctatgcaaaggcatagcaagttaaaataaggctttgtccgtcatcagcttttttaaagcagcgctgttctcggcgctttt

SEQ ID NO: 881 - DNA, 105 bp, synthetic construct
  misc_feature 1..105: note = source = /note="Description of Artificial Sequence: Syntheticpolynucleotide"
  source 1..105: mol_type = other DNA
cattgatacaaattagccgggttttagagctatgcaaaggcatagcaagttaaaataaggcttagtccgtaaacaaactttggcactgtattcggtgcttttttt

SEQ ID NO: 882 - DNA, 105 bp, synthetic construct
  misc_feature 1..105: note = source = /note="Description of Artificial Sequence: Syntheticpolynucleotide"
  source 1..105: mol_type = other DNA
ggcaaatgatgaagaaacttgttttagagctatgcaaaggcatagcaagttaaaataaggcttagtccgtaaacaaactttggcactgtattcggtgcttttttt

SEQ ID NO: 883 - DNA, 105 bp, synthetic construct
  misc_feature 1..105: note = source = /note="Description of Artificial Sequence: Syntheticpolynucleotide"
  source 1..105: mol_type = other DNA
gcaacattccggagcatcctgttttagagctatgcaaaggcatagcaagttaaaataaggcttagtccgtaaacaaactttggcactgtattcggtgcttttttt

SEQ ID NO: 884 - DNA, 110 bp, synthetic construct
  misc_feature 1..110: note = source = /note="Description of Artificial Sequence: Syntheticpolynucleotide"
  source 1..110: mol_type = other DNA
gaccacagccgcagcgtcatgttattgtactctcaataaaaagttattgagaatctacaataataaggcatcttgccgaatttaccgccctacatatgtagggcggtttt

SEQ ID NO: 885 - DNA, 110 bp, synthetic construct
  misc_feature 1..110: note = source = /note="Description of Artificial Sequence: Syntheticpolynucleotide"
  source 1..110: mol_type = other DNA
tcacctcagctggaccacaggttattgtactctcaataaaaagttattgagaatctacaataataaggcatcttgccgaatttaccgccctacatatgtagggcggtttt

SEQ ID NO: 886 - DNA, 110 bp, synthetic construct
  misc_feature 1..110: note = source = /note="Description of Artificial Sequence: Syntheticpolynucleotide"
  source 1..110: mol_type = other DNA
ggcccctcacctcagctggagttattgtactctcaataaaaagttattgagaatctacaataataaggcatcttgccgaatttaccgccctacatatgtagggcggtttt

SEQ ID NO: 887 - DNA, 110 bp, synthetic construct
  misc_feature 1..110: note = source = /note="Description of Artificial Sequence: Syntheticpolynucleotide"
  source 1..110: mol_type = other DNA
caggttttgaaagtttaggtgttattgtactctcaataaaaagttattgagaatctacaataataaggcatcttgccgaatttaccgccctacatatgtagggcggtttt

SEQ ID NO: 888 - DNA, 110 bp, synthetic construct
  misc_feature 1..110: note = source = /note="Description of Artificial Sequence: Syntheticpolynucleotide"
  source 1..110: mol_type = other DNA
gtcgagaaaagctttgaaacgttattgtactctcaataaaaagttattgagaatctacaataataaggcatcttgccgaatttaccgccctacatatgtagggcggtttt

SEQ ID NO: 889 - DNA, 110 bp, synthetic construct
  misc_feature 1..110: note = source = /note="Description of Artificial Sequence: Syntheticpolynucleotide"
  source 1..110: mol_type = other DNA
aaagcttttctcgaccagctgttattgtactctcaataaaaagttattgagaatctacaataataaggcatcttgccgaatttaccgccctacatatgtagggcggtttt

SEQ ID NO: 890 - DNA, 110 bp, synthetic construct
  misc_feature 1..110: note = source = /note="Description of Artificial Sequence: Syntheticpolynucleotide"
  source 1..110: mol_type = other DNA
ttttctcgaccagcttgacagttattgtactctcaataaaaagttattgagaatctacaataataaggcatcttgccgaatttaccgccctacatatgtagggcggtttt

SEQ ID NO: 891 - DNA, 110 bp, synthetic construct
  misc_feature 1..110: note = source = /note="Description of Artificial Sequence: Syntheticpolynucleotide"
  source 1..110: mol_type = other DNA
tccaatggaggcagcgaggcgttattgtactctcaataaaaagttattgagaatctacaataataaggcatcttgccgaatttaccgccctacatatgtagggcggtttt

SEQ ID NO: 892 - DNA, 110 bp, synthetic construct
  misc_feature 1..110: note = source = /note="Description of Artificial Sequence: Syntheticpolynucleotide"
  source 1..110: mol_type = other DNA
gggccataaagagtataaacgttattgtactctcaataaaaagttattgagaatctacaataataaggcatcttgccgaatttaccgccctacatatgtagggcggtttt

SEQ ID NO: 893 - DNA, 110 bp, synthetic construct
  misc_feature 1..110: note = source = /note="Description of Artificial Sequence: Syntheticpolynucleotide"
  source 1..110: mol_type = other DNA
aggcagctggattttggcctgttattgtactctcaataaaaagttattgagaatctacaataataaggcatcttgccgaatttaccgccctacatatgtagggcggtttt

SEQ ID NO: 894 - DNA, 110 bp, synthetic construct
  misc_feature 1..110: note = source = /note="Description of Artificial Sequence: Syntheticpolynucleotide"
  source 1..110: mol_type = other DNA
caatggtgcatcttggctcagttattgtactctcaataaaaagttattgagaatctacaataataaggcatcttgccgaatttaccgccctacatatgtagggcggtttt

SEQ ID NO: 895 - DNA, 110 bp, synthetic construct
  misc_feature 1..110: note = source = /note="Description of Artificial Sequence: Syntheticpolynucleotide"
  source 1..110: mol_type = other DNA
ttcctccacttcaacacctggttattgtactctcaataaaaagttattgagaatctacaataataaggcatcttgccgaatttaccgccctacatatgtagggcggtttt

SEQ ID NO: 896 - DNA, 110 bp, synthetic construct
  misc_feature 1..110: note = source = /note="Description of Artificial Sequence: Syntheticpolynucleotide"
  source 1..110: mol_type = other DNA
agtcacatggttcacacggcgttattgtactctcaataaaaagttattgagaatctacaataataaggcatcttgccgaatttaccgccctacatatgtagggcggtttt

SEQ ID NO: 897 - DNA, 110 bp, synthetic construct
  misc_feature 1..110: note = source = /note="Description of Artificial Sequence: Syntheticpolynucleotide"
  source 1..110: mol_type = other DNA
ctgtgacaaagtcacatggtgttattgtactctcaataaaaagttattgagaatctacaataataaggcatcttgccgaatttaccgccctacatatgtagggcggtttt

SEQ ID NO: 898 - DNA, 110 bp, synthetic construct
  misc_feature 1..110: note = source = /note="Description of Artificial Sequence: Syntheticpolynucleotide"
  source 1..110: mol_type = other DNA
aaagaccagtccttgctgaagttattgtactctcaataaaaagttattgagaatctacaataataaggcatcttgccgaatttaccgccctacatatgtagggcggtttt

SEQ ID NO: 899 - DNA, 110 bp, synthetic construct
  misc_feature 1..110: note = source = /note="Description of Artificial Sequence: Syntheticpolynucleotide"
  source 1..110: mol_type = other DNA
gagagagaattgaaaaagtggttattgtactctcaataaaaagttattgagaatctacaataataaggcatcttgccgaatttaccgccctacatatgtagggcggtttt

SEQ ID NO: 900 - DNA, 110 bp, synthetic construct
  misc_feature 1..110: note = source = /note="Description of Artificial Sequence: Syntheticpolynucleotide"
  source 1..110: mol_type = other DNA
cattctctgctggatgacgtgttattgtactctcaataaaaagttattgagaatctacaataataaggcatcttgccgaatttaccgccctacatatgtagggcggtttt

SEQ ID NO: 901 - DNA, 110 bp, synthetic construct
  misc_feature 1..110: note = source = /note="Description of Artificial Sequence: Syntheticpolynucleotide"
  source 1..110: mol_type = other DNA
gtgtctgggtttcatccatcgttattgtactctcaataaaaagttattgagaatctacaataataaggcatcttgccgaatttaccgccctacatatgtagggcggtttt

SEQ ID NO: 902 - DNA, 110 bp, synthetic construct
  misc_feature 1..110: note = source = /note="Description of Artificial Sequence: Syntheticpolynucleotide"
  source 1..110: mol_type = other DNA
tgagtaaacctgaatctttggttattgtactctcaataaaaagttattgagaatctacaataataaggcatcttgccgaatttaccgccctacatatgtagggcggtttt

SEQ ID NO: 903 - DNA, 110 bp, synthetic construct
  misc_feature 1..110: note = source = /note="Description of Artificial Sequence: Syntheticpolynucleotide"
  source 1..110: mol_type = other DNA
gcctccaggccagaaagagagttattgtactctcaataaaaagttattgagaatctacaataataaggcatcttgccgaatttaccgccctacatatgtagggcggtttt

SEQ ID NO: 904 - DNA, 110 bp, synthetic construct
  misc_feature 1..110: note = source = /note="Description of Artificial Sequence: Syntheticpolynucleotide"
  source 1..110: mol_type = other DNA
ccagaaagagagagtagcgcgttattgtactctcaataaaaagttattgagaatctacaataataaggcatcttgccgaatttaccgccctacatatgtagggcggtttt

SEQ ID NO: 905 - DNA, 110 bp, synthetic construct
  misc_feature 1..110: note = source = /note="Description of Artificial Sequence: Syntheticpolynucleotide"
  source 1..110: mol_type = other DNA
agaaagagagagtagcgcgagttattgtactctcaataaaaagttattgagaatctacaataataaggcatcttgccgaatttaccgccctacatatgtagggcggtttt

SEQ ID NO: 906 - DNA, 110 bp, synthetic construct
  misc_feature 1..110: note = source = /note="Description of Artificial Sequence: Syntheticpolynucleotide"
  source 1..110: mol_type = other DNA
acagctaaggccacggagcggttattgtactctcaataaaaagttattgagaatctacaataataaggcatcttgccgaatttaccgccctacatatgtagggcggtttt

SEQ ID NO: 907 - DNA, 110 bp, synthetic construct
  misc_feature 1..110: note = source = /note="Description of Artificial Sequence: Syntheticpolynucleotide"
  source 1..110: mol_type = other DNA
gggtaggagagactcacgctgttattgtactctcaataaaaagttattgagaatctacaataataaggcatcttgccgaatttaccgccctacatatgtagggcggtttt

SEQ ID NO: 908 - DNA, 110 bp, synthetic construct
  misc_feature 1..110: note = source = /note="Description of Artificial Sequence: Syntheticpolynucleotide"
  source 1..110: mol_type = other DNA
ggctgtggtgagccataattgttattgtactctcaataaaaagttattgagaatctacaataataaggcatcttgccgaatttaccgccctacatatgtagggcggtttt

SEQ ID NO: 909 - DNA, 110 bp, synthetic construct
  misc_feature 1..110: note = source = /note="Description of Artificial Sequence: Syntheticpolynucleotide"
  source 1..110: mol_type = other DNA
gggttcgaggctgtggtgaggttattgtactctcaataaaaagttattgagaatctacaataataaggcatcttgccgaatttaccgccctacatatgtagggcggtttt

SEQ ID NO: 910 - DNA, 110 bp, synthetic construct
  misc_feature 1..110: note = source = /note="Description of Artificial Sequence: Syntheticpolynucleotide"
  source 1..110: mol_type = other DNA
actctcacttaccttcattagttattgtactctcaataaaaagttattgagaatctacaataataaggcatcttgccgaatttaccgccctacatatgtagggcggtttt

SEQ ID NO: 911 - DNA, 110 bp, synthetic construct
  misc_feature 1..110: note = source = /note="Description of Artificial Sequence: Syntheticpolynucleotide"
  source 1..110: mol_type = other DNA
aaggaagaacagaccccccagttattgtactctcaataaaaagttattgagaatctacaataataaggcatcttgccgaatttaccgccctacatatgtagggcggtttt

SEQ ID NO: 912 - DNA, 110 bp, synthetic construct
  misc_feature 1..110: note = source = /note="Description of Artificial Sequence: Syntheticpolynucleotide"
  source 1..110: mol_type = other DNA
tttataatcttctaaaggaagttattgtactctcaataaaaagttattgagaatctacaataataaggcatcttgccgaatttaccgccctacatatgtagggcggtttt

SEQ ID NO: 913 - DNA, 110 bp, synthetic construct
  misc_feature 1..110: note = source = /note="Description of Artificial Sequence: Syntheticpolynucleotide"
  source 1..110: mol_type = other DNA
actctaaaggatcagctgatgttattgtactctcaataaaaagttattgagaatctacaataataaggcatcttgccgaatttaccgccctacatatgtagggcggtttt

SEQ ID NO: 914 - DNA, 110 bp, synthetic construct
  misc_feature 1..110: note = source = /note="Description of Artificial Sequence: Syntheticpolynucleotide"
  source 1..110: mol_type = other DNA
ttttggttccaagtccaatagttattgtactctcaataaaaagttattgagaatctacaataataaggcatcttgccgaatttaccgccctacatatgtagggcggtttt

SEQ ID NO: 915 - DNA, 110 bp, synthetic construct
  misc_feature 1..110: note = source = /note="Description of Artificial Sequence: Syntheticpolynucleotide"
  source 1..110: mol_type = other DNA
gacttggaaccaaaaggaatgttattgtactctcaataaaaagttattgagaatctacaataataaggcatcttgccgaatttaccgccctacatatgtagggcggtttt

SEQ ID NO: 916 - DNA, 110 bp, synthetic construct
  misc_feature 1..110: note = source = /note="Description of Artificial Sequence: Syntheticpolynucleotide"
  source 1..110: mol_type = other DNA
gacactaaatgtttttcctcgttattgtactctcaataaaaagttattgagaatctacaataataaggcatcttgccgaatttaccgccctacatatgtagggcggtttt

SEQ ID NO: 917 - DNA, 110 bp, synthetic construct
  misc_feature 1..110: note = source = /note="Description of Artificial Sequence: Syntheticpolynucleotide"
  source 1..110: mol_type = other DNA
aaacattaaagaagctgtaggttattgtactctcaataaaaagttattgagaatctacaataataaggcatcttgccgaatttaccgccctacatatgtagggcggtttt

SEQ ID NO: 918 - DNA, 110 bp, synthetic construct
  misc_feature 1..110: note = source = /note="Description of Artificial Sequence: Syntheticpolynucleotide"
  source 1..110: mol_type = other DNA
gccgtagcccccacacatatgttattgtactctcaataaaaagttattgagaatctacaataataaggcatcttgccgaatttaccgccctacatatgtagggcggtttt

SEQ ID NO: 919 - DNA, 110 bp, synthetic construct
  misc_feature 1..110: note = source = /note="Description of Artificial Sequence: Syntheticpolynucleotide"
  source 1..110: mol_type = other DNA
gatgctccggaatgttgctggttattgtactctcaataaaaagttattgagaatctacaataataaggcatcttgccgaatttaccgccctacatatgtagggcggtttt

SEQ ID NO: 920 - DNA, 110 bp, synthetic construct
  misc_feature 1..110: note = source = /note="Description of Artificial Sequence: Syntheticpolynucleotide"
  source 1..110: mol_type = other DNA
ttgatacaaattagccgggggttattgtactctcaataaaaagttattgagaatctacaataataaggcatcttgccgaatttaccgccctacatatgtagggcggtttt

SEQ ID NO: 921 - DNA, 110 bp, synthetic construct
  misc_feature 1..110: note = source = /note="Description of Artificial Sequence: Syntheticpolynucleotide"
  source 1..110: mol_type = other DNA
ttgccccagacctgtaataggttattgtactctcaataaaaagttattgagaatctacaataataaggcatcttgccgaatttaccgccctacatatgtagggcggtttt

SEQ ID NO: 922 - DNA, 110 bp, synthetic construct
  misc_feature 1..110: note = source = /note="Description of Artificial Sequence: Syntheticpolynucleotide"
  source 1..110: mol_type = other DNA
cttcatcatttgccccagacgttattgtactctcaataaaaagttattgagaatctacaataataaggcatcttgccgaatttaccgccctacatatgtagggcggtttt

SEQ ID NO: 923 - DNA, 110 bp, synthetic construct
  misc_feature 1..110: note = source = /note="Description of Artificial Sequence: Syntheticpolynucleotide"
  source 1..110: mol_type = other DNA
catcatttgccccagacctggttattgtactctcaataaaaagttattgagaatctacaataataaggcatcttgccgaatttaccgccctacatatgtagggcggtttt

SEQ ID NO: 924 - DNA, 110 bp, synthetic construct
  misc_feature 1..110: note = source = /note="Description of Artificial Sequence: Syntheticpolynucleotide"
  source 1..110: mol_type = other DNA
cacagtggcaagctcgccgtgttattgtactctcaataaaaagttattgagaatctacaataataaggcatcttgccgaatttaccgccctacatatgtagggcggtttt

SEQ ID NO: 925 - DNA, 110 bp, synthetic construct
  misc_feature 1..110: note = source = /note="Description of Artificial Sequence: Syntheticpolynucleotide"
  source 1..110: mol_type = other DNA
ccgtccacatgagccatgcggttattgtactctcaataaaaagttattgagaatctacaataataaggcatcttgccgaatttaccgccctacatatgtagggcggtttt

SEQ ID NO: 926 - DNA, 110 bp, synthetic construct
  misc_feature 1..110: note = source = /note="Description of Artificial Sequence: Syntheticpolynucleotide"
  source 1..110: mol_type = other DNA
atgagccatgcgctgcatgggttattgtactctcaataaaaagttattgagaatctacaataataaggcatcttgccgaatttaccgccctacatatgtagggcggtttt

SEQ ID NO: 927 - DNA, 110 bp, synthetic construct
  misc_feature 1..110: note = source = /note="Description of Artificial Sequence: Syntheticpolynucleotide"
  source 1..110: mol_type = other DNA
ttatgaacaacatgctaaatgttattgtactctcaataaaaagttattgagaatctacaataataaggcatcttgccgaatttaccgccctacatatgtagggcggtttt

SEQ ID NO: 928 - DNA, 110 bp, synthetic construct
  misc_feature 1..110: note = source = /note="Description of Artificial Sequence: Syntheticpolynucleotide"
  source 1..110: mol_type = other DNA
cccagacctgtaatagtcatgttattgtactctcaataaaaagttattgagaatctacaataataaggcatcttgccgaatttaccgccctacatatgtagggcggtttt

SEQ ID NO: 929 - DNA, 105 bp, synthetic construct
  misc_feature 1..105: note = source = /note="Description of Artificial Sequence: Syntheticpolynucleotide"
  source 1..105: mol_type = other DNA
gagggtaggagagactcacggttttagtactctgtaaaaagttacagaatctactaaaacaaggcaaaatgccgtgtttatctcgtcaacttgttggcgagattt

SEQ ID NO: 930 - DNA, 105 bp, synthetic construct
  misc_feature 1..105: note = source = /note="Description of Artificial Sequence: Syntheticpolynucleotide"
  source 1..105: mol_type = other DNA
acggagcgagacatctcggcgttttagtactctgtaaaaagttacagaatctactaaaacaaggcaaaatgccgtgtttatctcgtcaacttgttggcgagattt

SEQ ID NO: 931 - DNA, 105 bp, synthetic construct
  misc_feature 1..105: note = source = /note="Description of Artificial Sequence: Syntheticpolynucleotide"
  source 1..105: mol_type = other DNA
agcacagctaaggccacggagttttagtactctgtaaaaagttacagaatctactaaaacaaggcaaaatgccgtgtttatctcgtcaacttgttggcgagattt

SEQ ID NO: 932 - DNA, 105 bp, synthetic construct
  misc_feature 1..105: note = source = /note="Description of Artificial Sequence: Syntheticpolynucleotide"
  source 1..105: mol_type = other DNA
cgcgagcacagctaaggccagttttagtactctgtaaaaagttacagaatctactaaaacaaggcaaaatgccgtgtttatctcgtcaacttgttggcgagattt

SEQ ID NO: 933 - DNA, 105 bp, synthetic construct
  misc_feature 1..105: note = source = /note="Description of Artificial Sequence: Syntheticpolynucleotide"
  source 1..105: mol_type = other DNA
gcgcgagcacagctaaggccgttttagtactctgtaaaaagttacagaatctactaaaacaaggcaaaatgccgtgtttatctcgtcaacttgttggcgagattt

SEQ ID NO: 934 - DNA, 105 bp, synthetic construct
  misc_feature 1..105: note = source = /note="Description of Artificial Sequence: Syntheticpolynucleotide"
  source 1..105: mol_type = other DNA
cgctactctctctttctggcgttttagtactctgtaaaaagttacagaatctactaaaacaaggcaaaatgccgtgtttatctcgtcaacttgttggcgagattt

SEQ ID NO: 935 - DNA, 105 bp, synthetic construct
  misc_feature 1..105: note = source = /note="Description of Artificial Sequence: Syntheticpolynucleotide"
  source 1..105: mol_type = other DNA
ggccagaaagagagagtagcgttttagtactctgtaaaaagttacagaatctactaaaacaaggcaaaatgccgtgtttatctcgtcaacttgttggcgagattt

SEQ ID NO: 936 - DNA, 105 bp, synthetic construct
  misc_feature 1..105: note = source = /note="Description of Artificial Sequence: Syntheticpolynucleotide"
  source 1..105: mol_type = other DNA
gctactctctctttctggccgttttagtactctgtaaaaagttacagaatctactaaaacaaggcaaaatgccgtgtttatctcgtcaacttgttggcgagattt

SEQ ID NO: 937 - DNA, 105 bp, synthetic construct
  misc_feature 1..105: note = source = /note="Description of Artificial Sequence: Syntheticpolynucleotide"
  source 1..105: mol_type = other DNA
tagcctccaggccagaaagagttttagtactctgtaaaaagttacagaatctactaaaacaaggcaaaatgccgtgtttatctcgtcaacttgttggcgagattt

SEQ ID NO: 938 - DNA, 105 bp, synthetic construct
  misc_feature 1..105: note = source = /note="Description of Artificial Sequence: Syntheticpolynucleotide"
  source 1..105: mol_type = other DNA
tggatagcctccaggccagagttttagtactctgtaaaaagttacagaatctactaaaacaaggcaaaatgccgtgtttatctcgtcaacttgttggcgagattt

SEQ ID NO: 939 - DNA, 105 bp, synthetic construct
  misc_feature 1..105: note = source = /note="Description of Artificial Sequence: Syntheticpolynucleotide"
  source 1..105: mol_type = other DNA
tggcctggaggctatccagcgttttagtactctgtaaaaagttacagaatctactaaaacaaggcaaaatgccgtgtttatctcgtcaacttgttggcgagattt

SEQ ID NO: 940 - DNA, 105 bp, synthetic construct
  misc_feature 1..105: note = source = /note="Description of Artificial Sequence: Syntheticpolynucleotide"
  source 1..105: mol_type = other DNA
acgctggatagcctccaggcgttttagtactctgtaaaaagttacagaatctactaaaacaaggcaaaatgccgtgtttatctcgtcaacttgttggcgagattt

SEQ ID NO: 941 - DNA, 105 bp, synthetic construct
  misc_feature 1..105: note = source = /note="Description of Artificial Sequence: Syntheticpolynucleotide"
  source 1..105: mol_type = other DNA
gctaatttgtatcaatgattgttttagtactctgtaaaaagttacagaatctactaaaacaaggcaaaatgccgtgtttatctcgtcaacttgttggcgagattt

SEQ ID NO: 942 - DNA, 105 bp, synthetic construct
  misc_feature 1..105: note = source = /note="Description of Artificial Sequence: Syntheticpolynucleotide"
  source 1..105: mol_type = other DNA
taatagtcatatatagacttgttttagtactctgtaaaaagttacagaatctactaaaacaaggcaaaatgccgtgtttatctcgtcaacttgttggcgagattt

SEQ ID NO: 943 - DNA, 105 bp, synthetic construct
  misc_feature 1..105: note = source = /note="Description of Artificial Sequence: Syntheticpolynucleotide"
  source 1..105: mol_type = other DNA
gtaatagtcatatatagactgttttagtactctgtaaaaagttacagaatctactaaaacaaggcaaaatgccgtgtttatctcgtcaacttgttggcgagattt

SEQ ID NO: 944 - DNA, 105 bp, synthetic construct
  misc_feature 1..105: note = source = /note="Description of Artificial Sequence: Syntheticpolynucleotide"
  source 1..105: mol_type = other DNA
tatatatgactattacaggtgttttagtactctgtaaaaagttacagaatctactaaaacaaggcaaaatgccgtgtttatctcgtcaacttgttggcgagattt

SEQ ID NO: 945 - DNA, 105 bp, synthetic construct
  misc_feature 1..105: note = source = /note="Description of Artificial Sequence: Syntheticpolynucleotide"
  source 1..105: mol_type = other DNA
ttacaggtctggggcaaatggttttagtactctgtaaaaagttacagaatctactaaaacaaggcaaaatgccgtgtttatctcgtcaacttgttggcgagattt

SEQ ID NO: 946 - DNA, 105 bp, synthetic construct
  misc_feature 1..105: note = source = /note="Description of Artificial Sequence: Syntheticpolynucleotide"
  source 1..105: mol_type = other DNA
caggtctggggcaaatgatggttttagtactctgtaaaaagttacagaatctactaaaacaaggcaaaatgccgtgtttatctcgtcaacttgttggcgagattt

SEQ ID NO: 947 - DNA, 105 bp, synthetic construct
  misc_feature 1..105: note = source = /note="Description of Artificial Sequence: Syntheticpolynucleotide"
  source 1..105: mol_type = other DNA
gggtcagcatgccaatatgtgttttagtactctgtaaaaagttacagaatctactaaaacaaggcaaaatgccgtgtttatctcgtcaacttgttggcgagattt

SEQ ID NO: 948 - DNA, 105 bp, synthetic construct
  misc_feature 1..105: note = source = /note="Description of Artificial Sequence: Syntheticpolynucleotide"
  source 1..105: mol_type = other DNA
gcgcatggctcatgtggacggttttagtactctgtaaaaagttacagaatctactaaaacaaggcaaaatgccgtgtttatctcgtcaacttgttggcgagattt

SEQ ID NO: 949 - DNA, 105 bp, synthetic construct
  misc_feature 1..105: note = source = /note="Description of Artificial Sequence: Syntheticpolynucleotide"
  source 1..105: mol_type = other DNA
agctgtatccaaggatgctcgttttagtactctgtaaaaagttacagaatctactaaaacaaggcaaaatgccgtgtttatctcgtcaacttgttggcgagattt

SEQ ID NO: 950 - DNA, 105 bp, synthetic construct
  misc_feature 1..105: note = source = /note="Description of Artificial Sequence: Syntheticpolynucleotide"
  source 1..105: mol_type = other DNA
agcaacattccggagcatccgttttagtactctgtaaaaagttacagaatctactaaaacaaggcaaaatgccgtgtttatctcgtcaacttgttggcgagattt

SEQ ID NO: 951 - DNA, 105 bp, synthetic construct
  misc_feature 1..105: note = source = /note="Description of Artificial Sequence: Syntheticpolynucleotide"
  source 1..105: mol_type = other DNA
ccatgcagcgcatggctcatgttttagtactctgtaaaaagttacagaatctactaaaacaaggcaaaatgccgtgtttatctcgtcaacttgttggcgagattt

SEQ ID NO: 952 - DNA, 105 bp, synthetic construct
  misc_feature 1..105: note = source = /note="Description of Artificial Sequence: Syntheticpolynucleotide"
  source 1..105: mol_type = other DNA
gtggcaagctcgccgtccacgttttagtactctgtaaaaagttacagaatctactaaaacaaggcaaaatgccgtgtttatctcgtcaacttgttggcgagattt

SEQ ID NO: 953 - DNA, 105 bp, synthetic construct
  misc_feature 1..105: note = source = /note="Description of Artificial Sequence: Syntheticpolynucleotide"
  source 1..105: mol_type = other DNA
tggaaccaaaaggaatctatgttttagtactctgtaaaaagttacagaatctactaaaacaaggcaaaatgccgtgtttatctcgtcaacttgttggcgagattt

SEQ ID NO: 954 - DNA, 105 bp, synthetic construct
  misc_feature 1..105: note = source = /note="Description of Artificial Sequence: Syntheticpolynucleotide"
  source 1..105: mol_type = other DNA
atattggacttggaaccaaagttttagtactctgtaaaaagttacagaatctactaaaacaaggcaaaatgccgtgtttatctcgtcaacttgttggcgagattt

SEQ ID NO: 955 - DNA, 105 bp, synthetic construct
  misc_feature 1..105: note = source = /note="Description of Artificial Sequence: Syntheticpolynucleotide"
  source 1..105: mol_type = other DNA
agtccaatatggcaactctagttttagtactctgtaaaaagttacagaatctactaaaacaaggcaaaatgccgtgtttatctcgtcaacttgttggcgagattt

SEQ ID NO: 956 - DNA, 105 bp, synthetic construct
  misc_feature 1..105: note = source = /note="Description of Artificial Sequence: Syntheticpolynucleotide"
  source 1..105: mol_type = other DNA
tagagttgccatattggactgttttagtactctgtaaaaagttacagaatctactaaaacaaggcaaaatgccgtgtttatctcgtcaacttgttggcgagattt

SEQ ID NO: 957 - DNA, 105 bp, synthetic construct
  misc_feature 1..105: note = source = /note="Description of Artificial Sequence: Syntheticpolynucleotide"
  source 1..105: mol_type = other DNA
ttagagttgccatattggacgttttagtactctgtaaaaagttacagaatctactaaaacaaggcaaaatgccgtgtttatctcgtcaacttgttggcgagattt

SEQ ID NO: 958 - DNA, 105 bp, synthetic construct
  misc_feature 1..105: note = source = /note="Description of Artificial Sequence: Syntheticpolynucleotide"
  source 1..105: mol_type = other DNA
ttataaatcagctgatccttgttttagtactctgtaaaaagttacagaatctactaaaacaaggcaaaatgccgtgtttatctcgtcaacttgttggcgagattt

SEQ ID NO: 959 - DNA, 105 bp, synthetic construct
  misc_feature 1..105: note = source = /note="Description of Artificial Sequence: Syntheticpolynucleotide"
  source 1..105: mol_type = other DNA
gatttataatcttctaaagggttttagtactctgtaaaaagttacagaatctactaaaacaaggcaaaatgccgtgtttatctcgtcaacttgttggcgagattt

SEQ ID NO: 960 - DNA, 105 bp, synthetic construct
  misc_feature 1..105: note = source = /note="Description of Artificial Sequence: Syntheticpolynucleotide"
  source 1..105: mol_type = other DNA
ccagaataagattacagttggttttagtactctgtaaaaagttacagaatctactaaaacaaggcaaaatgccgtgtttatctcgtcaacttgttggcgagattt

SEQ ID NO: 961 - DNA, 105 bp, synthetic construct
  misc_feature 1..105: note = source = /note="Description of Artificial Sequence: Syntheticpolynucleotide"
  source 1..105: mol_type = other DNA
ccaacaactgtaatcttattgttttagtactctgtaaaaagttacagaatctactaaaacaaggcaaaatgccgtgtttatctcgtcaacttgttggcgagattt

SEQ ID NO: 962 - DNA, 105 bp, synthetic construct
  misc_feature 1..105: note = source = /note="Description of Artificial Sequence: Syntheticpolynucleotide"
  source 1..105: mol_type = other DNA
cctgtgccatcagtatcttagttttagtactctgtaaaaagttacagaatctactaaaacaaggcaaaatgccgtgtttatctcgtcaacttgttggcgagattt

SEQ ID NO: 963 - DNA, 105 bp, synthetic construct
  misc_feature 1..105: note = source = /note="Description of Artificial Sequence: Syntheticpolynucleotide"
  source 1..105: mol_type = other DNA
gtaagtgagagtctaccacagttttagtactctgtaaaaagttacagaatctactaaaacaaggcaaaatgccgtgtttatctcgtcaacttgttggcgagattt

SEQ ID NO: 964 - DNA, 105 bp, synthetic construct
  misc_feature 1..105: note = source = /note="Description of Artificial Sequence: Syntheticpolynucleotide"
  source 1..105: mol_type = other DNA
taagtgagagtctaccacacgttttagtactctgtaaaaagttacagaatctactaaaacaaggcaaaatgccgtgtttatctcgtcaacttgttggcgagattt

SEQ ID NO: 965 - DNA, 105 bp, synthetic construct
  misc_feature 1..105: note = source = /note="Description of Artificial Sequence: Syntheticpolynucleotide"
  source 1..105: mol_type = other DNA
cagacaaaactgtgctagacgttttagtactctgtaaaaagttacagaatctactaaaacaaggcaaaatgccgtgtttatctcgtcaacttgttggcgagattt

SEQ ID NO: 966 - DNA, 105 bp, synthetic construct
  misc_feature 1..105: note = source = /note="Description of Artificial Sequence: Syntheticpolynucleotide"
  source 1..105: mol_type = other DNA
acatgaggtctatggacttcgttttagtactctgtaaaaagttacagaatctactaaaacaaggcaaaatgccgtgtttatctcgtcaacttgttggcgagattt

SEQ ID NO: 967 - DNA, 105 bp, synthetic construct
  misc_feature 1..105: note = source = /note="Description of Artificial Sequence: Syntheticpolynucleotide"
  source 1..105: mol_type = other DNA
agagcaacagtgctgtggccgttttagtactctgtaaaaagttacagaatctactaaaacaaggcaaaatgccgtgtttatctcgtcaacttgttggcgagattt

SEQ ID NO: 968 - DNA, 105 bp, synthetic construct
  misc_feature 1..105: note = source = /note="Description of Artificial Sequence: Syntheticpolynucleotide"
  source 1..105: mol_type = other DNA
aggccacagcactgttgctcgttttagtactctgtaaaaagttacagaatctactaaaacaaggcaaaatgccgtgtttatctcgtcaacttgttggcgagattt

SEQ ID NO: 969 - DNA, 105 bp, synthetic construct
  misc_feature 1..105: note = source = /note="Description of Artificial Sequence: Syntheticpolynucleotide"
  source 1..105: mol_type = other DNA
gctggggaagaaggtgtcttgttttagtactctgtaaaaagttacagaatctactaaaacaaggcaaaatgccgtgtttatctcgtcaacttgttggcgagattt

SEQ ID NO: 970 - DNA, 105 bp, synthetic construct
  misc_feature 1..105: note = source = /note="Description of Artificial Sequence: Syntheticpolynucleotide"
  source 1..105: mol_type = other DNA
ccttcttccccagcccaggtgttttagtactctgtaaaaagttacagaatctactaaaacaaggcaaaatgccgtgtttatctcgtcaacttgttggcgagattt

SEQ ID NO: 971 - DNA, 105 bp, synthetic construct
  misc_feature 1..105: note = source = /note="Description of Artificial Sequence: Syntheticpolynucleotide"
  source 1..105: mol_type = other DNA
ggcaccaaagctgcccttacgttttagtactctgtaaaaagttacagaatctactaaaacaaggcaaaatgccgtgtttatctcgtcaacttgttggcgagattt

SEQ ID NO: 972 - DNA, 105 bp, synthetic construct
  misc_feature 1..105: note = source = /note="Description of Artificial Sequence: Syntheticpolynucleotide"
  source 1..105: mol_type = other DNA
tacacggcagggtcagggttgttttagtactctgtaaaaagttacagaatctactaaaacaaggcaaaatgccgtgtttatctcgtcaacttgttggcgagattt

SEQ ID NO: 973 - DNA, 105 bp, synthetic construct
  misc_feature 1..105: note = source = /note="Description of Artificial Sequence: Syntheticpolynucleotide"
  source 1..105: mol_type = other DNA
ctgaccctgccgtgtaccaggttttagtactctgtaaaaagttacagaatctactaaaacaaggcaaaatgccgtgtttatctcgtcaacttgttggcgagattt

SEQ ID NO: 974 - DNA, 105 bp, synthetic construct
  misc_feature 1..105: note = source = /note="Description of Artificial Sequence: Syntheticpolynucleotide"
  source 1..105: mol_type = other DNA
cagctggtacacggcagggtgttttagtactctgtaaaaagttacagaatctactaaaacaaggcaaaatgccgtgtttatctcgtcaacttgttggcgagattt

SEQ ID NO: 975 - DNA, 105 bp, synthetic construct
  misc_feature 1..105: note = source = /note="Description of Artificial Sequence: Syntheticpolynucleotide"
  source 1..105: mol_type = other DNA
gtctctcagctggtacacgggttttagtactctgtaaaaagttacagaatctactaaaacaaggcaaaatgccgtgtttatctcgtcaacttgttggcgagattt

SEQ ID NO: 976 - DNA, 105 bp, synthetic construct
  misc_feature 1..105: note = source = /note="Description of Artificial Sequence: Syntheticpolynucleotide"
  source 1..105: mol_type = other DNA
gacagacttgtcactggattgttttagtactctgtaaaaagttacagaatctactaaaacaaggcaaaatgccgtgtttatctcgtcaacttgttggcgagattt

SEQ ID NO: 977 - DNA, 109 bp, synthetic construct
  misc_feature 1..109: note = source = /note="Description of Artificial Sequence: Syntheticpolynucleotide"
  source 1..109: mol_type = other DNA
agagtctctcagctggtacagttttagagctatgcaaaggcatagcaagttaaaataaggctttgtccgtcatcagcttttttaaagcagcgctgttctcggcgctttt

SEQ ID NO: 978 - DNA, 109 bp, synthetic construct
  misc_feature 1..109: note = source = /note="Description of Artificial Sequence: Syntheticpolynucleotide"
  source 1..109: mol_type = other DNA
agagcaacagtgctgtggccgttttagagctatgcaaaggcatagcaagttaaaataaggctttgtccgtcatcagcttttttaaagcagcgctgttctcggcgctttt

SEQ ID NO: 979 - DNA, 109 bp, synthetic construct
  misc_feature 1..109: note = source = /note="Description of Artificial Sequence: Syntheticpolynucleotide"
  source 1..109: mol_type = other DNA
tcagggttctggatatctgtgttttagagctatgcaaaggcatagcaagttaaaataaggctttgtccgtcatcagcttttttaaagcagcgctgttctcggcgctttt

SEQ ID NO: 980 - DNA, 109 bp, synthetic construct
  misc_feature 1..109: note = source = /note="Description of Artificial Sequence: Syntheticpolynucleotide"
  source 1..109: mol_type = other DNA
cttacctgggctggggaagagttttagagctatgcaaaggcatagcaagttaaaataaggctttgtccgtcatcagcttttttaaagcagcgctgttctcggcgctttt

SEQ ID NO: 981 - DNA, 109 bp, synthetic construct
  misc_feature 1..109: note = source = /note="Description of Artificial Sequence: Syntheticpolynucleotide"
  source 1..109: mol_type = other DNA
ttcgtatctgtaaaaccaaggttttagagctatgcaaaggcatagcaagttaaaataaggctttgtccgtcatcagcttttttaaagcagcgctgttctcggcgctttt

SEQ ID NO: 982 - DNA, 109 bp, synthetic construct
  misc_feature 1..109: note = source = /note="Description of Artificial Sequence: Syntheticpolynucleotide"
  source 1..109: mol_type = other DNA
tttcaaaacctgtcagtgatgttttagagctatgcaaaggcatagcaagttaaaataaggctttgtccgtcatcagcttttttaaagcagcgctgttctcggcgctttt

SEQ ID NO: 983 - DNA, 109 bp, synthetic construct
  misc_feature 1..109: note = source = /note="Description of Artificial Sequence: Syntheticpolynucleotide"
  source 1..109: mol_type = other DNA
ttcaaaacctgtcagtgattgttttagagctatgcaaaggcatagcaagttaaaataaggctttgtccgtcatcagcttttttaaagcagcgctgttctcggcgctttt

SEQ ID NO: 984 - DNA, 109 bp, synthetic construct
  misc_feature 1..109: note = source = /note="Description of Artificial Sequence: Syntheticpolynucleotide"
  source 1..109: mol_type = other DNA
gctggtacacggcagggtcagttttagagctatgcaaaggcatagcaagttaaaataaggctttgtccgtcatcagcttttttaaagcagcgctgttctcggcgctttt

SEQ ID NO: 985 - DNA, 109 bp, synthetic construct
  misc_feature 1..109: note = source = /note="Description of Artificial Sequence: Syntheticpolynucleotide"
  source 1..109: mol_type = other DNA
gtggcgcattgccacgaagcgttttagagctatgcaaaggcatagcaagttaaaataaggctttgtccgtcatcagcttttttaaagcagcgctgttctcggcgctttt

SEQ ID NO: 986 - DNA, 109 bp, synthetic construct
  misc_feature 1..109: note = source = /note="Description of Artificial Sequence: Syntheticpolynucleotide"
  source 1..109: mol_type = other DNA
ttcttcttctgctcggactcgttttagagctatgcaaaggcatagcaagttaaaataaggctttgtccgtcatcagcttttttaaagcagcgctgttctcggcgctttt

SEQ ID NO: 987 - DNA, 109 bp, synthetic construct
  misc_feature 1..109: note = source = /note="Description of Artificial Sequence: Syntheticpolynucleotide"
  source 1..109: mol_type = other DNA
accggaggacaaagtacaaagttttagagctatgcaaaggcatagcaagttaaaataaggctttgtccgtcatcagcttttttaaagcagcgctgttctcggcgctttt

SEQ ID NO: 988 - DNA, 108 bp, synthetic construct
  misc_feature 1..108: note = source = /note="Description of Artificial Sequence: Syntheticpolynucleotide"
  source 1..108: mol_type = other DNA
gagcccttcttcttctgctgttttagagctatgcaaaggcatagcaagttaaaataaggctttgtccgtcatcagcttttttaaagcagcgctgttctcggcgctttt

SEQ ID NO: 989 - DNA, 108 bp, synthetic construct
  misc_feature 1..108: note = source = /note="Description of Artificial Sequence: Syntheticpolynucleotide"
  source 1..108: mol_type = other DNA
cgccaccggttgatgtgatgttttagagctatgcaaaggcatagcaagttaaaataaggctttgtccgtcatcagcttttttaaagcagcgctgttctcggcgctttt

SEQ ID NO: 990 - DNA, 109 bp, synthetic construct
  misc_feature 1..109: note = source = /note="Description of Artificial Sequence: Syntheticpolynucleotide"
  source 1..109: mol_type = other DNA
gtcacctccaatgactaggggttttagagctatgcaaaggcatagcaagttaaaataaggctttgtccgtcatcagcttttttaaagcagcgctgttctcggcgctttt

SEQ ID NO: 991 - DNA, 109 bp, synthetic construct
  misc_feature 1..109: note = source = /note="Description of Artificial Sequence: Syntheticpolynucleotide"
  source 1..109: mol_type = other DNA
gacatcgatgtcctccccatgttttagagctatgcaaaggcatagcaagttaaaataaggctttgtccgtcatcagcttttttaaagcagcgctgttctcggcgctttt

SEQ ID NO: 992 - DNA, 109 bp, synthetic construct
  misc_feature 1..109: note = source = /note="Description of Artificial Sequence: Syntheticpolynucleotide"
  source 1..109: mol_type = other DNA
ggggcacagatgagaaactcgttttagagctatgcaaaggcatagcaagttaaaataaggctttgtccgtcatcagcttttttaaagcagcgctgttctcggcgctttt

SEQ ID NO: 993 - DNA, 109 bp, synthetic construct
  misc_feature 1..109: note = source = /note="Description of Artificial Sequence: Syntheticpolynucleotide"
  source 1..109: mol_type = other DNA
gtacaaacggcagaagctgggttttagagctatgcaaaggcatagcaagttaaaataaggctttgtccgtcatcagcttttttaaagcagcgctgttctcggcgctttt

SEQ ID NO: 994 - DNA, 109 bp, synthetic construct
  misc_feature 1..109: note = source = /note="Description of Artificial Sequence: Syntheticpolynucleotide"
  source 1..109: mol_type = other DNA
ggcagaagctggaggaggaagttttagagctatgcaaaggcatagcaagttaaaataaggctttgtccgtcatcagcttttttaaagcagcgctgttctcggcgctttt

SEQ ID NO: 995 - DNA, 109 bp, synthetic construct
  misc_feature 1..109: note = source = /note="Description of Artificial Sequence: Syntheticpolynucleotide"
  source 1..109: mol_type = other DNA
gggcaaccacaaacccacgagttttagagctatgcaaaggcatagcaagttaaaataaggctttgtccgtcatcagcttttttaaagcagcgctgttctcggcgctttt

SEQ ID NO: 996 - DNA, 109 bp, synthetic construct
  misc_feature 1..109: note = source = /note="Description of Artificial Sequence: Syntheticpolynucleotide"
  source 1..109: mol_type = other DNA
gctcccatcacatcaaccgggttttagagctatgcaaaggcatagcaagttaaaataaggctttgtccgtcatcagcttttttaaagcagcgctgttctcggcgctttt

SEQ ID NO: 997 - DNA, 109 bp, synthetic construct
  misc_feature 1..109: note = source = /note="Description of Artificial Sequence: Syntheticpolynucleotide"
  source 1..109: mol_type = other DNA
ggcagagtgctgcttgctgcgttttagagctatgcaaaggcatagcaagttaaaataaggctttgtccgtcatcagcttttttaaagcagcgctgttctcggcgctttt

SEQ ID NO: 998 - DNA, 109 bp, synthetic construct
  misc_feature 1..109: note = source = /note="Description of Artificial Sequence: Syntheticpolynucleotide"
  source 1..109: mol_type = other DNA
gcccctgcgtgggcccaagcgttttagagctatgcaaaggcatagcaagttaaaataaggctttgtccgtcatcagcttttttaaagcagcgctgttctcggcgctttt

SEQ ID NO: 999 - DNA, 109 bp, synthetic construct
  misc_feature 1..109: note = source = /note="Description of Artificial Sequence: Syntheticpolynucleotide"
  source 1..109: mol_type = other DNA
gagtggccagagtccagcttgttttagagctatgcaaaggcatagcaagttaaaataaggctttgtccgtcatcagcttttttaaagcagcgctgttctcggcgctttt

SEQ ID NO: 1000 - DNA, 109 bp, synthetic construct
  misc_feature 1..109: note = source = /note="Description of Artificial Sequence: Syntheticpolynucleotide"
  source 1..109: mol_type = other DNA
aacctgtgaaaatgctccccgttttagagctatgcaaaggcatagcaagttaaaataaggctttgtccgtcatcagcttttttaaagcagcgctgttctcggcgctttt

SEQ ID NO: 1001 - DNA, 109 bp, synthetic construct
  misc_feature 1..109: note = source = /note="Description of Artificial Sequence: Syntheticpolynucleotide"
  source 1..109: mol_type = other DNA
tgttctgccagaaattgtgggttttagagctatgcaaaggcatagcaagttaaaataaggctttgtccgtcatcagcttttttaaagcagcgctgttctcggcgctttt

SEQ ID NO: 1002 - DNA, 109 bp, synthetic construct
  misc_feature 1..109: note = source = /note="Description of Artificial Sequence: Syntheticpolynucleotide"
  source 1..109: mol_type = other DNA
agtctatatatgactattacgttttagagctatgcaaaggcatagcaagttaaaataaggctttgtccgtcatcagcttttttaaagcagcgctgttctcggcgctttt

SEQ ID NO: 1003 - DNA, 109 bp, synthetic construct
  misc_feature 1..109: note = source = /note="Description of Artificial Sequence: Syntheticpolynucleotide"
  source 1..109: mol_type = other DNA
tcagctgggaagatatcaaagttttagagctatgcaaaggcatagcaagttaaaataaggctttgtccgtcatcagcttttttaaagcagcgctgttctcggcgctttt

SEQ ID NO: 1004 - DNA, 109 bp, synthetic construct
  misc_feature 1..109: note = source = /note="Description of Artificial Sequence: Syntheticpolynucleotide"
  source 1..109: mol_type = other DNA
aatagacccatctatcagctgttttagagctatgcaaaggcatagcaagttaaaataaggctttgtccgtcatcagcttttttaaagcagcgctgttctcggcgctttt

SEQ ID NO: 1005 - DNA, 109 bp, synthetic construct
  misc_feature 1..109: note = source = /note="Description of Artificial Sequence: Syntheticpolynucleotide"
  source 1..109: mol_type = other DNA
aatcattgatacaaattagcgttttagagctatgcaaaggcatagcaagttaaaataaggctttgtccgtcatcagcttttttaaagcagcgctgttctcggcgctttt

SEQ ID NO: 1006 - DNA, 109 bp, synthetic construct
  misc_feature 1..109: note = source = /note="Description of Artificial Sequence: Syntheticpolynucleotide"
  source 1..109: mol_type = other DNA
atcattgatacaaattagccgttttagagctatgcaaaggcatagcaagttaaaataaggctttgtccgtcatcagcttttttaaagcagcgctgttctcggcgctttt

SEQ ID NO: 1007 - DNA, 109 bp, synthetic construct
  misc_feature 1..109: note = source = /note="Description of Artificial Sequence: Syntheticpolynucleotide"
  source 1..109: mol_type = other DNA
cagtggacttgctgcatatggttttagagctatgcaaaggcatagcaagttaaaataaggctttgtccgtcatcagcttttttaaagcagcgctgttctcggcgctttt

SEQ ID NO: 1008 - DNA, 109 bp, synthetic construct
  misc_feature 1..109: note = source = /note="Description of Artificial Sequence: Syntheticpolynucleotide"
  source 1..109: mol_type = other DNA
cactgatgttctgaaagctcgttttagagctatgcaaaggcatagcaagttaaaataaggctttgtccgtcatcagcttttttaaagcagcgctgttctcggcgctttt

SEQ ID NO: 1009 - DNA, 109 bp, synthetic construct
  misc_feature 1..109: note = source = /note="Description of Artificial Sequence: Syntheticpolynucleotide"
  source 1..109: mol_type = other DNA
ctttccgcacacccccgtccgttttagagctatgcaaaggcatagcaagttaaaataaggctttgtccgtcatcagcttttttaaagcagcgctgttctcggcgctttt

SEQ ID NO: 1010 - DNA, 109 bp, synthetic construct
  misc_feature 1..109: note = source = /note="Description of Artificial Sequence: Syntheticpolynucleotide"
  source 1..109: mol_type = other DNA
atatgactattacaggtctggttttagagctatgcaaaggcatagcaagttaaaataaggctttgtccgtcatcagcttttttaaagcagcgctgttctcggcgctttt

SEQ ID NO: 1011 - DNA, 109 bp, synthetic construct
  misc_feature 1..109: note = source = /note="Description of Artificial Sequence: Syntheticpolynucleotide"
  source 1..109: mol_type = other DNA
gagatgatggatctccaacagttttagagctatgcaaaggcatagcaagttaaaataaggctttgtccgtcatcagcttttttaaagcagcgctgttctcggcgctttt

SEQ ID NO: 1012 - DNA, 109 bp, synthetic construct
  misc_feature 1..109: note = source = /note="Description of Artificial Sequence: Syntheticpolynucleotide"
  source 1..109: mol_type = other DNA
tatttcttttagtgcctgtagttttagagctatgcaaaggcatagcaagttaaaataaggctttgtccgtcatcagcttttttaaagcagcgctgttctcggcgctttt

SEQ ID NO: 1013 - DNA, 109 bp, synthetic construct
  misc_feature 1..109: note = source = /note="Description of Artificial Sequence: Syntheticpolynucleotide"
  source 1..109: mol_type = other DNA
agactctgcacccagatttagttttagagctatgcaaaggcatagcaagttaaaataaggctttgtccgtcatcagcttttttaaagcagcgctgttctcggcgctttt

SEQ ID NO: 1014 - DNA, 109 bp, synthetic construct
  misc_feature 1..109: note = source = /note="Description of Artificial Sequence: Syntheticpolynucleotide"
  source 1..109: mol_type = other DNA
ctttatcagtccctaaatctgttttagagctatgcaaaggcatagcaagttaaaataaggctttgtccgtcatcagcttttttaaagcagcgctgttctcggcgctttt

SEQ ID NO: 1015 - DNA, 109 bp, synthetic construct
  misc_feature 1..109: note = source = /note="Description of Artificial Sequence: Syntheticpolynucleotide"
  source 1..109: mol_type = other DNA
tttagggactgataaagatagttttagagctatgcaaaggcatagcaagttaaaataaggctttgtccgtcatcagcttttttaaagcagcgctgttctcggcgctttt

SEQ ID NO: 1016 - DNA, 109 bp, synthetic construct
  misc_feature 1..109: note = source = /note="Description of Artificial Sequence: Syntheticpolynucleotide"
  source 1..109: mol_type = other DNA
gctggtcattatcacggctggttttagagctatgcaaaggcatagcaagttaaaataaggctttgtccgtcatcagcttttttaaagcagcgctgttctcggcgctttt

SEQ ID NO: 1017 - DNA, 109 bp, synthetic construct
  misc_feature 1..109: note = source = /note="Description of Artificial Sequence: Syntheticpolynucleotide"
  source 1..109: mol_type = other DNA
cctatcatacagtgcttatggttttagagctatgcaaaggcatagcaagttaaaataaggctttgtccgtcatcagcttttttaaagcagcgctgttctcggcgctttt

SEQ ID NO: 1018 - DNA, 109 bp, synthetic construct
  misc_feature 1..109: note = source = /note="Description of Artificial Sequence: Syntheticpolynucleotide"
  source 1..109: mol_type = other DNA
tacagagagtccaatagcccgttttagagctatgcaaaggcatagcaagttaaaataaggctttgtccgtcatcagcttttttaaagcagcgctgttctcggcgctttt

SEQ ID NO: 1019 - DNA, 109 bp, synthetic construct
  misc_feature 1..109: note = source = /note="Description of Artificial Sequence: Syntheticpolynucleotide"
  source 1..109: mol_type = other DNA
ccttaatcatggtggaaactgttttagagctatgcaaaggcatagcaagttaaaataaggctttgtccgtcatcagcttttttaaagcagcgctgttctcggcgctttt

SEQ ID NO: 1020 - DNA, 109 bp, synthetic construct
  misc_feature 1..109: note = source = /note="Description of Artificial Sequence: Syntheticpolynucleotide"
  source 1..109: mol_type = other DNA
tagacctaccttaatcatgggttttagagctatgcaaaggcatagcaagttaaaataaggctttgtccgtcatcagcttttttaaagcagcgctgttctcggcgctttt

SEQ ID NO: 1021 - DNA, 109 bp, synthetic construct
  misc_feature 1..109: note = source = /note="Description of Artificial Sequence: Syntheticpolynucleotide"
  source 1..109: mol_type = other DNA
acatagacctaccttaatcagttttagagctatgcaaaggcatagcaagttaaaataaggctttgtccgtcatcagcttttttaaagcagcgctgttctcggcgctttt

SEQ ID NO: 1022 - DNA, 109 bp, synthetic construct
  misc_feature 1..109: note = source = /note="Description of Artificial Sequence: Syntheticpolynucleotide"
  source 1..109: mol_type = other DNA
gggtggggggagtttgctccgttttagagctatgcaaaggcatagcaagttaaaataaggctttgtccgtcatcagcttttttaaagcagcgctgttctcggcgctttt

SEQ ID NO: 1023 - DNA, 20 bp, synthetic construct
  misc_feature 1..20: note = source = /note="Description of Artificial Sequence: Syntheticoligonucleotide"
  source 1..20: mol_type = other DNA
aactcatgcctgctgctctt

SEQ ID NO: 1024 - DNA, 20 bp, synthetic construct
  misc_feature 1..20: note = source = /note="Description of Artificial Sequence: Syntheticoligonucleotide"
  source 1..20: mol_type = other DNA
cagtctcacgcagtcactca

SEQ ID NO: 1025 - DNA, 20 bp, synthetic construct
  misc_feature 1..20: note = source = /note="Description of Artificial Sequence: Syntheticoligonucleotide"
  source 1..20: mol_type = other DNA
aactgaggcggctgaaatga

SEQ ID NO: 1026 - DNA, 20 bp, synthetic construct
  misc_feature 1..20: note = source = /note="Description of Artificial Sequence: Syntheticoligonucleotide"
  source 1..20: mol_type = other DNA
tgggacatgcaagcccataa

SEQ ID NO: 1027 - DNA, 21 bp, synthetic construct
  misc_feature 1..21: note = source = /note="Description of Artificial Sequence: Syntheticoligonucleotide"
  source 1..21: mol_type = other DNA
aagatgttgacatgctcttcc

SEQ ID NO: 1028 - DNA, 19 bp, synthetic construct
  misc_feature 1..19: note = source = /note="Description of Artificial Sequence: Syntheticoligonucleotide"
  source 1..19: mol_type = other DNA
tatgcagtcaaaagcctca

SEQ ID NO: 1029 - DNA, 20 bp, synthetic construct
  misc_feature 1..20: note = source = /note="Description of Artificial Sequence: Syntheticoligonucleotide"
  source 1..20: mol_type = other DNA
aagtcatttgcttgtttgga

SEQ ID NO: 1030 - DNA, 20 bp, synthetic construct
  misc_feature 1..20: note = source = /note="Description of Artificial Sequence: Syntheticoligonucleotide"
  source 1..20: mol_type = other DNA
tggtgcattcagagaaggag

SEQ ID NO: 1031 - DNA, 20 bp, synthetic construct
  misc_feature 1..20: note = source = /note="Description of Artificial Sequence: Syntheticoligonucleotide"
  source 1..20: mol_type = other DNA
aatgaagccaggcaagagca

SEQ ID NO: 1032 - DNA, 20 bp, synthetic construct
  misc_feature 1..20: note = source = /note="Description of Artificial Sequence: Syntheticoligonucleotide"
  source 1..20: mol_type = other DNA
ctgtgcaaacccaggctaga

SEQ ID NO: 1033 - DNA, 19 bp, synthetic construct
  misc_feature 1..19: note = source = /note="Description of Artificial Sequence: Syntheticoligonucleotide"
  source 1..19: mol_type = other DNA
acatttgacgagcagcgaa

SEQ ID NO: 1034 - DNA, 20 bp, synthetic construct
  misc_feature 1..20: note = source = /note="Description of Artificial Sequence: Syntheticoligonucleotide"
  source 1..20: mol_type = other DNA
ggcccctggagaggttttaa

SEQ ID NO: 1035 - DNA, 20 bp, synthetic construct
  misc_feature 1..20: note = source = /note="Description of Artificial Sequence: Syntheticoligonucleotide"
  source 1..20: mol_type = other DNA
acccggcctgcttttcttaa

SEQ ID NO: 1036 - DNA, 20 bp, synthetic construct
  misc_feature 1..20: note = source = /note="Description of Artificial Sequence: Syntheticoligonucleotide"
  source 1..20: mol_type = other DNA
ggcagcgaggcatacatagt

SEQ ID NO: 1037 - DNA, 20 bp, synthetic construct
  misc_feature 1..20: note = source = /note="Description of Artificial Sequence: Syntheticoligonucleotide"
  source 1..20: mol_type = other DNA
accctgctttttctgccttt

SEQ ID NO: 1038 - DNA, 23 bp, synthetic construct
  misc_feature 1..23: note = source = /note="Description of Artificial Sequence: Syntheticoligonucleotide"
  source 1..23: mol_type = other DNA
caggcctaatggacattaatcct

SEQ ID NO: 1039 - DNA, 20 bp, synthetic construct
  misc_feature 1..20: note = source = /note="Description of Artificial Sequence: Syntheticoligonucleotide"
  source 1..20: mol_type = other DNA
actcactaaggggcccatct

SEQ ID NO: 1040 - DNA, 20 bp, synthetic construct
  misc_feature 1..20: note = source = /note="Description of Artificial Sequence: Syntheticoligonucleotide"
  source 1..20: mol_type = other DNA
caggaggaggattcggaacc

SEQ ID NO: 1041 - DNA, 22 bp, synthetic construct
  misc_feature 1..22: note = source = /note="Description of Artificial Sequence: Syntheticoligonucleotide"
  source 1..22: mol_type = other DNA
aggaaaatgaatcacaattact

SEQ ID NO: 1042 - DNA, 20 bp, synthetic construct
  misc_feature 1..20: note = source = /note="Description of Artificial Sequence: Syntheticoligonucleotide"
  source 1..20: mol_type = other DNA
gtgcgaaagggcaagattct

SEQ ID NO: 1043 - DNA, 24 bp, synthetic construct
  misc_feature 1..24: note = source = /note="Description of Artificial Sequence: Syntheticoligonucleotide"
  source 1..24: mol_type = other DNA
aggcctttcaactctcttttggca

SEQ ID NO: 1044 - DNA, 21 bp, synthetic construct
  misc_feature 1..21: note = source = /note="Description of Artificial Sequence: Syntheticoligonucleotide"
  source 1..21: mol_type = other DNA
ggatggggtcaaggtatgggc

SEQ ID NO: 1045 - DNA, 20 bp, synthetic construct
  misc_feature 1..20: note = source = /note="Description of Artificial Sequence: Syntheticoligonucleotide"
  source 1..20: mol_type = other DNA
atgacattcaggccacagtg

SEQ ID NO: 1046 - DNA, 20 bp, synthetic construct
  misc_feature 1..20: note = source = /note="Description of Artificial Sequence: Syntheticoligonucleotide"
  source 1..20: mol_type = other DNA
cttcctcctattcaggccca

SEQ ID NO: 1047 - DNA, 20 bp, synthetic construct
  misc_feature 1..20: note = source = /note="Description of Artificial Sequence: Syntheticoligonucleotide"
  source 1..20: mol_type = other DNA
cagcttttgaaatggggtgc

SEQ ID NO: 1048 - DNA, 22 bp, synthetic construct
  misc_feature 1..22: note = source = /note="Description of Artificial Sequence: Syntheticoligonucleotide"
  source 1..22: mol_type = other DNA
caacaaatggagaccatctgga

SEQ ID NO: 1049 - DNA, 23 bp, synthetic construct
  misc_feature 1..23: note = source = /note="Description of Artificial Sequence: Syntheticoligonucleotide"
  source 1..23: mol_type = other DNA
cagtattctaaggacgccagaaa

SEQ ID NO: 1050 - DNA, 18 bp, synthetic construct
  misc_feature 1..18: note = source = /note="Description of Artificial Sequence: Syntheticoligonucleotide"
  source 1..18: mol_type = other DNA
gcactttgggaggctgaa

SEQ ID NO: 1051 - DNA, 18 bp, synthetic construct
  misc_feature 1..18: note = source = /note="Description of Artificial Sequence: Syntheticoligonucleotide"
  source 1..18: mol_type = other DNA
cgggcattcctgaagctg

SEQ ID NO: 1052 - DNA, 19 bp, synthetic construct
  misc_feature 1..19: note = source = /note="Description of Artificial Sequence: Syntheticoligonucleotide"
  source 1..19: mol_type = other DNA
gtaggccaaaggtctcccc

SEQ ID NO: 1053 - DNA, 20 bp, synthetic construct
  misc_feature 1..20: note = source = /note="Description of Artificial Sequence: Syntheticoligonucleotide"
  source 1..20: mol_type = other DNA
cttgacaccaagttagcccc

SEQ ID NO: 1054 - DNA, 21 bp, synthetic construct
  misc_feature 1..21: note = source = /note="Description of Artificial Sequence: Syntheticoligonucleotide"
  source 1..21: mol_type = other DNA
tcatacacaactttcagcagc

SEQ ID NO: 1055 - DNA, 20 bp, synthetic construct
  misc_feature 1..20: note = source = /note="Description of Artificial Sequence: Syntheticoligonucleotide"
  source 1..20: mol_type = other DNA
cttgtagctggaggtccatc

SEQ ID NO: 1056 - DNA, 20 bp, synthetic construct
  misc_feature 1..20: note = source = /note="Description of Artificial Sequence: Syntheticoligonucleotide"
  source 1..20: mol_type = other DNA
tgttggcaaatctagtctcg

SEQ ID NO: 1057 - DNA, 22 bp, synthetic construct
  misc_feature 1..22: note = source = /note="Description of Artificial Sequence: Syntheticoligonucleotide"
  source 1..22: mol_type = other DNA
gagcagctgagtcaatgatagt

SEQ ID NO: 1058 - DNA, 22 bp, synthetic construct
  misc_feature 1..22: note = source = /note="Description of Artificial Sequence: Syntheticoligonucleotide"
  source 1..22: mol_type = other DNA
ggagagatctggagggaactta

SEQ ID NO: 1059 - DNA, 20 bp, synthetic construct
  misc_feature 1..20: note = source = /note="Description of Artificial Sequence: Syntheticoligonucleotide"
  source 1..20: mol_type = other DNA
gcaaagtgagtgacctgctt

SEQ ID NO: 1060 - DNA, 18 bp, synthetic construct
  misc_feature 1..18: note = source = /note="Description of Artificial Sequence: Syntheticoligonucleotide"
  source 1..18: mol_type = other DNA
gagctagcacttctcgcg

SEQ ID NO: 1061 - DNA, 20 bp, synthetic construct
  misc_feature 1..20: note = source = /note="Description of Artificial Sequence: Syntheticoligonucleotide"
  source 1..20: mol_type = other DNA
gctgtttgggaggtcagaaa

SEQ ID NO: 1062 - DNA, 20 bp, synthetic construct
  misc_feature 1..20: note = source = /note="Description of Artificial Sequence: Syntheticoligonucleotide"
  source 1..20: mol_type = other DNA
gaatattgaagggggcaggg

SEQ ID NO: 1063 - DNA, 19 bp, synthetic construct
  misc_feature 1..19: note = source = /note="Description of Artificial Sequence: Syntheticoligonucleotide"
  source 1..19: mol_type = other DNA
ggacacttcccaaaggacc

SEQ ID NO: 1064 - DNA, 20 bp, synthetic construct
  misc_feature 1..20: note = source = /note="Description of Artificial Sequence: Syntheticoligonucleotide"
  source 1..20: mol_type = other DNA
cacgtcctcactctcgaaga

SEQ ID NO: 1065 - DNA, 22 bp, synthetic construct
  misc_feature 1..22: note = source = /note="Description of Artificial Sequence: Syntheticoligonucleotide"
  source 1..22: mol_type = other DNA
ggccttcactcttcacagaccc

SEQ ID NO: 1066 - DNA, 21 bp, synthetic construct
  misc_feature 1..21: note = source = /note="Description of Artificial Sequence: Syntheticoligonucleotide"
  source 1..21: mol_type = other DNA
ggatggggtcaaggtatgggc

SEQ ID NO: 1067 - DNA, 20 bp, synthetic construct
  misc_feature 1..20: note = source = /note="Description of Artificial Sequence: Syntheticoligonucleotide"
  source 1..20: mol_type = other DNA
gggcaaagagggaaatgaga

SEQ ID NO: 1068 - DNA, 20 bp, synthetic construct
  misc_feature 1..20: note = source = /note="Description of Artificial Sequence: Syntheticoligonucleotide"
  source 1..20: mol_type = other DNA
gaacctggccattcctgaag

SEQ ID NO: 1069 - DNA, 21 bp, synthetic construct
  misc_feature 1..21: note = source = /note="Description of Artificial Sequence: Syntheticoligonucleotide"
  source 1..21: mol_type = other DNA
ggtttttggaggtggagttga

SEQ ID NO: 1070 - DNA, 21 bp, synthetic construct
  misc_feature 1..21: note = source = /note="Description of Artificial Sequence: Syntheticoligonucleotide"
  source 1..21: mol_type = other DNA
ccccctaaccaagtgaaaaga

SEQ ID NO: 1071 - DNA, 24 bp, synthetic construct
  misc_feature 1..24: note = source = /note="Description of Artificial Sequence: Syntheticoligonucleotide"
  source 1..24: mol_type = other DNA
tagataaatgagcagtgaacagcc

SEQ ID NO: 1072 - DNA, 22 bp, synthetic construct
  misc_feature 1..22: note = source = /note="Description of Artificial Sequence: Syntheticoligonucleotide"
  source 1..22: mol_type = other DNA
tccacaaaggatcacaaagtca

SEQ ID NO: 1073 - DNA, 20 bp, synthetic construct
  misc_feature 1..20: note = source = /note="Description of Artificial Sequence: Syntheticoligonucleotide"
  source 1..20: mol_type = other DNA
tgagagacagtgggacagac

SEQ ID NO: 1074 - DNA, 20 bp, synthetic construct
  misc_feature 1..20: note = source = /note="Description of Artificial Sequence: Syntheticoligonucleotide"
  source 1..20: mol_type = other DNA
agtcctagaggaggcagaac

SEQ ID NO: 1075 - DNA, 20 bp, synthetic construct
  misc_feature 1..20: note = source = /note="Description of Artificial Sequence: Syntheticoligonucleotide"
  source 1..20: mol_type = other DNA
tgagtccgagcagaagaaga

SEQ ID NO: 1076 - DNA, 20 bp, synthetic construct
  misc_feature 1..20: note = source = /note="Description of Artificial Sequence: Syntheticoligonucleotide"
  source 1..20: mol_type = other DNA
ggagattggagacacggaga

SEQ ID NO: 1077 - DNA, 21 bp, synthetic construct
  misc_feature 1..21: note = source = /note="Description of Artificial Sequence: Syntheticoligonucleotide"
  source 1..21: mol_type = other DNA
tggaggtggagttgaataaca

SEQ ID NO: 1078 - DNA, 21 bp, synthetic construct
  misc_feature 1..21: note = source = /note="Description of Artificial Sequence: Syntheticoligonucleotide"
  source 1..21: mol_type = other DNA
ctttctccccctaaccaagtg

SEQ ID NO: 1079 - DNA, 21 bp, synthetic construct
  misc_feature 1..21: note = source = /note="Description of Artificial Sequence: Syntheticoligonucleotide"
  source 1..21: mol_type = other DNA
tggatctccaacatggcagcc

SEQ ID NO: 1080 - DNA, 21 bp, synthetic construct
  misc_feature 1..21: note = source = /note="Description of Artificial Sequence: Syntheticoligonucleotide"
  source 1..21: mol_type = other DNA
cggaaggctaaggagggagga

SEQ ID NO: 1081 - DNA, 20 bp, synthetic construct
  misc_feature 1..20: note = source = /note="Description of Artificial Sequence: Syntheticoligonucleotide"
  source 1..20: mol_type = other DNA
tggcccctatgtggagatca

SEQ ID NO: 1082 - DNA, 20 bp, synthetic construct
  misc_feature 1..20: note = source = /note="Description of Artificial Sequence: Syntheticoligonucleotide"
  source 1..20: mol_type = other DNA
ggcagagctcagcctcatag

SEQ ID NO: 1083 - DNA, 20 bp, synthetic construct
  misc_feature 1..20: note = source = /note="Description of Artificial Sequence: Syntheticoligonucleotide"
  source 1..20: mol_type = other DNA
tgttagacccatgggagcag

SEQ ID NO: 1084 - DNA, 19 bp, synthetic construct
  misc_feature 1..19: note = source = /note="Description of Artificial Sequence: Syntheticoligonucleotide"
  source 1..19: mol_type = other DNA
gttgcccaccctagtcatt

SEQ ID NO: 1085 - DNA, 21 bp, synthetic construct
  misc_feature 1..21: note = source = /note="Description of Artificial Sequence: Syntheticoligonucleotide"
  source 1..21: mol_type = other DNA
ttccacgctaaggtatgggcc

SEQ ID NO: 1086 - DNA, 20 bp, synthetic construct
  misc_feature 1..20: note = source = /note="Description of Artificial Sequence: Syntheticoligonucleotide"
  source 1..20: mol_type = other DNA
gccaacagcaccaaccccaa

SEQ ID NO: 1087 - DNA, 21 bp, synthetic construct
  misc_feature 1..21: note = source = /note="Description of Artificial Sequence: Syntheticoligonucleotide"
  source 1..21: mol_type = other DNA
ttgctcacttgatgtaagcaa

SEQ ID NO: 1088 - DNA, 20 bp, synthetic construct
  misc_feature 1..20: note = source = /note="Description of Artificial Sequence: Syntheticoligonucleotide"
  source 1..20: mol_type = other DNA
ttttggtacggtctttgtgt

SEQ ID NO: 1089 - protein, 116 aa, synthetic construct
  REGION 1..116: note = source = /note="Description of Artificial Sequence: Syntheticpolypeptide"
MKTTTQELKQYITRLFQLSNNETWECEALEEAAENILPERFINNSLLAHLTLNTYTYYNDELHELSIYPFLMYANDQLISIGYLDHFDMDFLYLTDTKNTIIDERHLLKQGENNHE

SEQ ID NO: 1090 - protein, 1509 aa, synthetic construct
  REGION 1..1509: note = source = /note="Description of Artificial Sequence: Syntheticpolypeptide"
MEASPASRPRPLMDPHMFTGNFTNNPRVFGLHQTYLCYEVKRQGPDGTRDLMNEQRDFLCNQAKNHFSGSEDHHAERCFLDRIPSWQLDPAQTYRVTCFISWSPCFSCAQEVAEFLHENPHVNLRIFAARIYDYLPRYEEGLQMLQNAGAQVSIMTSEEFGHCWDTFVDRQGHPFQPWEGLDEHSQALSGRLQAILQNQGNSGGSSGGSSGSETPGTSESATPESSGGSSGGSMYSIGLALGISSVGWSVIDEETGKIVDLGIRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPTQKEFILTELMTKEFARFGVNDIAKLLGVKKEQLSGWRLDKKGKPEIHTLKGYRNWRKIFAESGIDLATLPTETIDCLAKVLTLNTEREGVENTLAFELPELAEPVKLLVLDRYKELSQSVSTQAWHRFSLKTLHLLIPELIKSTSEQNTLLEQFQLKADVRKRYSDYKKLPTKEVLTEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESCPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGNKLRKFNTDILGKKHHLSYEKEPKNIIKSGGSGGSGGSMKTTTQELKQYITRLFQLSNNETWECEALEEAAENILPERFINNSLLAHLTLNTYTYYNDELHELSIYPFLMYANDQLISIGYLDHFDMDFLYLTDTKNTIIDERHLLKQGENNHE

SEQ ID NO: 1091 - protein, 1411 aa, synthetic construct
  REGION 1..1411: note = source = /note="Description of Artificial Sequence: Syntheticpolypeptide"
MEASPASRPRPLMDPHMFTGNFTNNPRVFGLHQTYLCYEVKRQGPDGTRDLMNEQRDFLCNQAKNHFSGSEDHHAERCFLDRIPSWQLDPAQTYRVTCFISWSPCFSCAQEVAEFLHENPHVNLRIFAARIYDYLPRYEEGLQMLQNAGAQVSIMTSEEFGHCWDTFVDRQGHPFQPWEGLDEHSQALSGRLQAILQNQGNSGGSSGGSSGSETPGTSESATPESSGGSSGGSMVTKYILGLAIGITSVGYGIINYEDKTIIDAGVRLFPEANVENNEGRRSKRGARRLKRRRIHRLDRIKQLLSEYNLVDLDNIPQSPSPYEIRVKGLREELSKDELVIALLHIAKRRGIHNVEAVDETQDEGNELSTKEQLAKNNNLLKDKYVCELLLERLKDGKVRGEKNRFKTTDIIKEVKQLLETQKEAHQLDDDFINRYIDLIETRREYFEGPGKGSPFGWGGDLKKWYETLMGHCTYFPNELRSVKYSYSADLFNALNDLNNLVIQREGNSKLEYHEKYHIIENVFKQKKKPTLKQIANEIGVSPDDIKGFRINKSGKETFTEFKLYHDLKKVLIDQSILENVQLLDQIAEILTIYQDKESIINELNQLSEIINEQDKESISNLSGYNGTHRLSLKCINLVIEELWHTSRNQMEIFTYLNIKPKKIDLAKTNKIPKNMIDEFILSPVVKRTFGQAINVINKVIEKYGVPEDIIIELARESNSKDKQKFINSLQKKNETTRKRINEIIGQYGNQNAKRLVEKIRLHDEQEGKCLYSLESIPLEDLINNPQYYEVDHIIPRSVSFDNSYQNKVLVKQTENSKKSNRTPYQYFNSGETKLSYNQFKQHVLNLSKSKDRISKKKKEYLLEERDINKYEVQKEFINRNLVDTRYATRELTNYLKAYFSANDMDVKVKTINGSFTDYLRKVWKFKKERNHGYKHHAEDALIIANADFLFKENKKLKKANAILEQPSLDNGKSDATVENDNEYVETFSIPKQVNDIKEFRDFKFSHRVDKKPNRQLINDTLYSTRKIENHTFIVSPITNIYSKDNDELKKKFNKNPEKFLMYQHDPKTFEKLEVIMKQYANEKNPLAKYHEETGEYLTKYSKKNNGPIVKTIKVLGDKVGKHLDVTHKYKYSNSKIVKKTINPYRFDVYLTDKGYKFITISYLDVLKKDNYYYILKEKYEELKIKKSISDTDQFIGSFYYNDLIKINDQIFKVVGVNNDLLNRIELDLLDISYKEYCKINNIKTNRIIKGITKKITNIEKFSTDVLGNLYKAHSNHPQLIFKQRDSGGSGGSGGSMKTTTQELKQYITRLFQLSNNETWECEALEEAAENILPERFINNSLLAHLTLNTYTYYNDELHELSIYPFLMYANDQLISIGYLDHFDMDFLYLTDTKNTIIDERHLLKQGENNHE

SEQ ID NO: 1092 - DNA, 20 bp, synthetic construct
  misc_feature 1..20: note = source = /note="Description of Artificial Sequence: Syntheticoligonucleotide"
  source 1..20: mol_type = other DNA
ccttaatgtgcctccagcct

SEQ ID NO: 1093 - DNA, 20 bp, synthetic construct
  misc_feature 1..20: note = source = /note="Description of Artificial Sequence: Syntheticoligonucleotide"
  source 1..20: mol_type = other DNA
aggagagactcacgctggat

SEQ ID NO: 1094 - DNA, 20 bp, synthetic construct
  misc_feature 1..20: note = source = /note="Description of Artificial Sequence: Syntheticoligonucleotide"
  source 1..20: mol_type = other DNA
cccttgtccatcactggcat

SEQ ID NO: 1095 - DNA, 20 bp, synthetic construct
  misc_feature 1..20: note = source = /note="Description of Artificial Sequence: Syntheticoligonucleotide"
  source 1..20: mol_type = other DNA
accaaagctgcccttacctg

SEQ ID NO: 1096 - DNA, 20 bp, synthetic construct
  misc_feature 1..20: note = source = /note="Description of Artificial Sequence: Syntheticoligonucleotide"
  source 1..20: mol_type = other DNA
cccttgtccatcactggcat

SEQ ID NO: 1097 - DNA, 20 bp, synthetic construct
  misc_feature 1..20: note = source = /note="Description of Artificial Sequence: Syntheticoligonucleotide"
  source 1..20: mol_type = other DNA
accaaagctgcccttacctg

SEQ ID NO: 1098 - DNA, 25 bp, synthetic construct
  misc_feature 1..25: note = source = /note="Description of Artificial Sequence: Syntheticoligonucleotide"
  source 1..25: mol_type = other DNA
agcacagctaaggcctaaagttgaa

SEQ ID NO: 1099 - DNA, 25 bp, synthetic construct
  misc_feature 1..25: note = source = /note="Description of Artificial Sequence: Syntheticoligonucleotide"
  source 1..25: mol_type = other DNA
agcacagctaaggcaccggattgga

SEQ ID NO: 1100 - DNA, 25 bp, synthetic construct
  misc_feature 1..25: note = source = /note="Description of Artificial Sequence: Syntheticoligonucleotide"
  source 1..25: mol_type = other DNA
agcacagccaaggccaagggctgac

SEQ ID NO: 1101 - DNA, 25 bp, synthetic construct
  misc_feature 1..25: note = source = /note="Description of Artificial Sequence: Syntheticoligonucleotide"
  source 1..25: mol_type = other DNA
agcagagctaaggccaaggcaggtg

SEQ ID NO: 1102 - DNA, 25 bp, synthetic construct
  misc_feature 1..25: note = source = /note="Description of Artificial Sequence: Syntheticoligonucleotide"
  source 1..25: mol_type = other DNA
ggcacagctaaggccagcagtggcc

SEQ ID NO: 1103 - DNA, 25 bp, synthetic construct
  misc_feature 1..25: note = source = /note="Description of Artificial Sequence: Syntheticoligonucleotide"
  source 1..25: mol_type = other DNA
gtctctgagctggtacatggcagag

SEQ ID NO: 1104 - DNA, 25 bp, synthetic construct
  misc_feature 1..25: note = source = /note="Description of Artificial Sequence: Syntheticoligonucleotide"
  source 1..25: mol_type = other DNA
gtcttttagctggtacacgtgtgtc

SEQ ID NO: 1105 - DNA, 25 bp, synthetic construct
  misc_feature 1..25: note = source = /note="Description of Artificial Sequence: Syntheticoligonucleotide"
  source 1..25: mol_type = other DNA
agaagatttgtcactggattctgag

SEQ ID NO: 1106 - DNA, 25 bp, synthetic construct
  misc_feature 1..25: note = source = /note="Description of Artificial Sequence: Syntheticoligonucleotide"
  source 1..25: mol_type = other DNA
aggacacttgtcactggatttagga

SEQ ID NO: 1107 - DNA, 25 bp, synthetic construct
  misc_feature 1..25: note = source = /note="Description of Artificial Sequence: Syntheticoligonucleotide"
  source 1..25: mol_type = other DNA
aggacacttgtcactggatttagga

SEQ ID NO: 1108 - DNA, 25 bp, synthetic construct
  misc_feature 1..25: note = source = /note="Description of Artificial Sequence: Syntheticoligonucleotide"
  source 1..25: mol_type = other DNA
tgaggacttgtcactggattcaggg

SEQ ID NO: 1109 - DNA, 25 bp, synthetic construct
  misc_feature 1..25: note = source = /note="Description of Artificial Sequence: Syntheticoligonucleotide"
  source 1..25: mol_type = other DNA
aggagacttttcactggatttaggg

SEQ ID NO: 1110 - DNA, 25 bp, synthetic construct
  misc_feature 1..25: note = source = /note="Description of Artificial Sequence: Syntheticoligonucleotide"
  source 1..25: mol_type = other DNA
tggacacttgtcactggatttaggg

SEQ ID NO: 1111 - DNA, 25 bp, synthetic construct
  misc_feature 1..25: note = source = /note="Description of Artificial Sequence: Syntheticoligonucleotide"
  source 1..25: mol_type = other DNA
cacagacttgtcactggatgtgggg

SEQ ID NO: 1112 - DNA, 25 bp, synthetic construct
  misc_feature 1..25: note = source = /note="Description of Artificial Sequence: Syntheticoligonucleotide"
  source 1..25: mol_type = other DNA
tacagacatgtcactggatctggaa

SEQ ID NO: 1113 - DNA, 25 bp, synthetic construct
  misc_feature 1..25: note = source = /note="Description of Artificial Sequence: Syntheticoligonucleotide"
  source 1..25: mol_type = other DNA
aacacacttgtcattggatttaggg

SEQ ID NO: 1114 - DNA, 25 bp, synthetic construct
  misc_feature 1..25: note = source = /note="Description of Artificial Sequence: Syntheticoligonucleotide"
  source 1..25: mol_type = other DNA
tacagactggtcactggatgctggt

SEQ ID NO: 1115 - DNA, 25 bp, synthetic construct
  misc_feature 1..25: note = source = /note="Description of Artificial Sequence: Syntheticoligonucleotide"
  source 1..25: mol_type = other DNA
aggacacttgtcactggatttagca

SEQ ID NO: 1116 - DNA, 25 bp, synthetic construct
  misc_feature 1..25: note = source = /note="Description of Artificial Sequence: Syntheticoligonucleotide"
  source 1..25: mol_type = other DNA
ctaagacttgttactggattgtgtg

SEQ ID NO: 1117 - DNA, 25 bp, synthetic construct
  misc_feature 1..25: note = source = /note="Description of Artificial Sequence: Syntheticoligonucleotide"
  source 1..25: mol_type = other DNA
ctcagactggtcactggataatgta

SEQ ID NO: 1118 - DNA, 20 bp, synthetic construct
  misc_feature 1..20: note = source = /note="Description of Artificial Sequence: Syntheticoligonucleotide"
  source 1..20: mol_type = other DNA
ccagaagccagcagatgaca

SEQ ID NO: 1119 - DNA, 20 bp, synthetic construct
  misc_feature 1..20: note = source = /note="Description of Artificial Sequence: Syntheticoligonucleotide"
  source 1..20: mol_type = other DNA
gagtggtgggctctcaatcc

SEQ ID NO: 1120 - DNA, 20 bp, synthetic construct
  misc_feature 1..20: note = source = /note="Description of Artificial Sequence: Syntheticoligonucleotide"
  source 1..20: mol_type = other DNA
agcaacaccatccaaaggtt

SEQ ID NO: 1121 - DNA, 20 bp, synthetic construct
  misc_feature 1..20: note = source = /note="Description of Artificial Sequence: Syntheticoligonucleotide"
  source 1..20: mol_type = other DNA
gggagtgatgataatgcggg

SEQ ID NO: 1122 - DNA, 20 bp, synthetic construct
  misc_feature 1..20: note = source = /note="Description of Artificial Sequence: Syntheticoligonucleotide"
  source 1..20: mol_type = other DNA
tggactagagagggttgggg

SEQ ID NO: 1123 - DNA, 20 bp, synthetic construct
  misc_feature 1..20: note = source = /note="Description of Artificial Sequence: Syntheticoligonucleotide"
  source 1..20: mol_type = other DNA
tctctttccacgagcagcag

SEQ ID NO: 1124 - DNA, 20 bp, synthetic construct
  misc_feature 1..20: note = source = /note="Description of Artificial Sequence: Syntheticoligonucleotide"
  source 1..20: mol_type = other DNA
gcctttgaccttcccagatt

SEQ ID NO: 1125 - DNA, 20 bp, synthetic construct
  misc_feature 1..20: note = source = /note="Description of Artificial Sequence: Syntheticoligonucleotide"
  source 1..20: mol_type = other DNA
accattggaaaggtggatgc

SEQ ID NO: 1126 - DNA, 20 bp, synthetic construct
  misc_feature 1..20: note = source = /note="Description of Artificial Sequence: Syntheticoligonucleotide"
  source 1..20: mol_type = other DNA
ggcttcaggctttcctctgt

SEQ ID NO: 1127 - DNA, 20 bp, synthetic construct
  misc_feature 1..20: note = source = /note="Description of Artificial Sequence: Syntheticoligonucleotide"
  source 1..20: mol_type = other DNA
agcatgctggcctaaagtga

SEQ ID NO: 1128 - DNA, 20 bp, synthetic construct
  misc_feature 1..20: note = source = /note="Description of Artificial Sequence: Syntheticoligonucleotide"
  source 1..20: mol_type = other DNA
accattggtctgctcaggtg

SEQ ID NO: 1129 - DNA, 20 bp, synthetic construct
  misc_feature 1..20: note = source = /note="Description of Artificial Sequence: Syntheticoligonucleotide"
  source 1..20: mol_type = other DNA
ccaaaacctgcagtggcttc

SEQ ID NO: 1130 - DNA, 20 bp, synthetic construct
  misc_feature 1..20: note = source = /note="Description of Artificial Sequence: Syntheticoligonucleotide"
  source 1..20: mol_type = other DNA
ggagaggaactgggcatgag

SEQ ID NO: 1131 - DNA, 20 bp, synthetic construct
  misc_feature 1..20: note = source = /note="Description of Artificial Sequence: Syntheticoligonucleotide"
  source 1..20: mol_type = other DNA
tccgtctctcctaggtctgc

SEQ ID NO: 1132 - DNA, 20 bp, synthetic construct
  misc_feature 1..20: note = source = /note="Description of Artificial Sequence: Syntheticoligonucleotide"
  source 1..20: mol_type = other DNA
ccatgactggcccttctgtt

SEQ ID NO: 1133 - DNA, 20 bp, synthetic construct
  misc_feature 1..20: note = source = /note="Description of Artificial Sequence: Syntheticoligonucleotide"
  source 1..20: mol_type = other DNA
gggtagagtacatggcgacg

SEQ ID NO: 1134 - DNA, 20 bp, synthetic construct
  misc_feature 1..20: note = source = /note="Description of Artificial Sequence: Syntheticoligonucleotide"
  source 1..20: mol_type = other DNA
ccctcccaccagaagctcta

SEQ ID NO: 1135 - DNA, 20 bp, synthetic construct
  misc_feature 1..20: note = source = /note="Description of Artificial Sequence: Syntheticoligonucleotide"
  source 1..20: mol_type = other DNA
gataagaggcccaaggaccg

SEQ ID NO: 1136 - DNA, 20 bp, synthetic construct
  misc_feature 1..20: note = source = /note="Description of Artificial Sequence: Syntheticoligonucleotide"
  source 1..20: mol_type = other DNA
cacttgacacgtgagcctct

SEQ ID NO: 1137 - DNA, 20 bp, synthetic construct
  misc_feature 1..20: note = source = /note="Description of Artificial Sequence: Syntheticoligonucleotide"
  source 1..20: mol_type = other DNA
cctctttcagcctctggtgg

SEQ ID NO: 1138 - DNA, 20 bp, synthetic construct
  misc_feature 1..20: note = source = /note="Description of Artificial Sequence: Syntheticoligonucleotide"
  source 1..20: mol_type = other DNA
gacagacttggttctgccct

SEQ ID NO: 1139 - DNA, 20 bp, synthetic construct
  misc_feature 1..20: note = source = /note="Description of Artificial Sequence: Syntheticoligonucleotide"
  source 1..20: mol_type = other DNA
cctcccctccttcctagctt

SEQ ID NO: 1140 - DNA, 20 bp, synthetic construct
  misc_feature 1..20: note = source = /note="Description of Artificial Sequence: Syntheticoligonucleotide"
  source 1..20: mol_type = other DNA
tgctgtagtgggtcgaacag

SEQ ID NO: 1141 - DNA, 20 bp, synthetic construct
  misc_feature 1..20: note = source = /note="Description of Artificial Sequence: Syntheticoligonucleotide"
  source 1..20: mol_type = other DNA
tttcaccatgctggctaggc

SEQ ID NO: 1142 - DNA, 20 bp, synthetic construct
  misc_feature 1..20: note = source = /note="Description of Artificial Sequence: Syntheticoligonucleotide"
  source 1..20: mol_type = other DNA
cccagccacatggaactaag

SEQ ID NO: 1143 - DNA, 20 bp, synthetic construct
  misc_feature 1..20: note = source = /note="Description of Artificial Sequence: Syntheticoligonucleotide"
  source 1..20: mol_type = other DNA
ggaccctaggagttccttgt

SEQ ID NO: 1144 - DNA, 20 bp, synthetic construct
  misc_feature 1..20: note = source = /note="Description of Artificial Sequence: Syntheticoligonucleotide"
  source 1..20: mol_type = other DNA
gcaggttgatagggaagagc

SEQ ID NO: 1145 - DNA, 20 bp, synthetic construct
  misc_feature 1..20: note = source = /note="Description of Artificial Sequence: Syntheticoligonucleotide"
  source 1..20: mol_type = other DNA
tcatctcccagctgatgaca

SEQ ID NO: 1146 - DNA, 20 bp, synthetic construct
  misc_feature 1..20: note = source = /note="Description of Artificial Sequence: Syntheticoligonucleotide"
  source 1..20: mol_type = other DNA
ccacctgttgcacaaatccg

SEQ ID NO: 1147 - DNA, 20 bp, synthetic construct
  misc_feature 1..20: note = source = /note="Description of Artificial Sequence: Syntheticoligonucleotide"
  source 1..20: mol_type = other DNA
tcctcccctgggaacatgat

SEQ ID NO: 1148 - DNA, 20 bp, synthetic construct
  misc_feature 1..20: note = source = /note="Description of Artificial Sequence: Syntheticoligonucleotide"
  source 1..20: mol_type = other DNA
gaggtactgggagtggggat

SEQ ID NO: 1149 - DNA, 20 bp, synthetic construct
  misc_feature 1..20: note = source = /note="Description of Artificial Sequence: Syntheticoligonucleotide"
  source 1..20: mol_type = other DNA
cttcctgcctcttccagctc

SEQ ID NO: 1150 - DNA, 20 bp, synthetic construct
  misc_feature 1..20: note = source = /note="Description of Artificial Sequence: Syntheticoligonucleotide"
  source 1..20: mol_type = other DNA
gcacagcttttgtcatgggg

SEQ ID NO: 1151 - DNA, 21 bp, synthetic construct
  misc_feature 1..21: note = source = /note="Description of Artificial Sequence: Syntheticoligonucleotide"
  source 1..21: mol_type = other DNA
ggggatgagaaaacagagcca

SEQ ID NO: 1152 - DNA, 20 bp, synthetic construct
  misc_feature 1..20: note = source = /note="Description of Artificial Sequence: Syntheticoligonucleotide"
  source 1..20: mol_type = other DNA
ccatgccccattctgaaggt

SEQ ID NO: 1153 - DNA, 20 bp, synthetic construct
  misc_feature 1..20: note = source = /note="Description of Artificial Sequence: Syntheticoligonucleotide"
  source 1..20: mol_type = other DNA
ttcccctcctctagactgcc

SEQ ID NO: 1154 - DNA, 20 bp, synthetic construct
  misc_feature 1..20: note = source = /note="Description of Artificial Sequence: Syntheticoligonucleotide"
  source 1..20: mol_type = other DNA
cttgagcccaggagtttgag

SEQ ID NO: 1155 - DNA, 20 bp, synthetic construct
  misc_feature 1..20: note = source = /note="Description of Artificial Sequence: Syntheticoligonucleotide"
  source 1..20: mol_type = other DNA
tgcattcttgggatgacctc

SEQ ID NO: 1156 - DNA, 20 bp, synthetic construct
  misc_feature 1..20: note = source = /note="Description of Artificial Sequence: Syntheticoligonucleotide"
  source 1..20: mol_type = other DNA
actgcttttccctggacaca

SEQ ID NO: 1157 - DNA, 20 bp, synthetic construct
  misc_feature 1..20: note = source = /note="Description of Artificial Sequence: Syntheticoligonucleotide"
  source 1..20: mol_type = other DNA
ggtcacaagtcccactggtc

SEQ ID NO: 1158 - DNA, 37 bp, synthetic construct
  misc_feature 1..37: note = source = /note="Description of Artificial Sequence: Syntheticoligonucleotide"
  source 1..37: mol_type = other DNA
agcacagctaaggccacggagttttagtactctgtaa

SEQ ID NO: 1159 - DNA, 37 bp, synthetic construct
  misc_feature 1..37: note = source = /note="Description of Artificial Sequence: Syntheticoligonucleotide"
  source 1..37: mol_type = other DNA
cgcgagcacagctaaggccagttttagtactctgtaa

SEQ ID NO: 1160 - DNA, 37 bp, synthetic construct
  misc_feature 1..37: note = source = /note="Description of Artificial Sequence: Syntheticoligonucleotide"
  source 1..37: mol_type = other DNA
tagcctccaggccagaaagagttttagtactctgtaa

SEQ ID NO: 1161 - DNA, 37 bp, synthetic construct
  misc_feature 1..37: note = source = /note="Description of Artificial Sequence: Syntheticoligonucleotide"
  source 1..37: mol_type = other DNA
tggcctggaggctatccagcgttttagtactctgtaa

SEQ ID NO: 1162 - DNA, 42 bp, synthetic construct
  misc_feature 1..42: note = source = /note="Description of Artificial Sequence: Syntheticoligonucleotide"
  source 1..42: mol_type = other DNA
gcgcgagcacagctaaggccacggagttttagtactctgtaa

SEQ ID NO: 1163 - DNA, 42 bp, synthetic construct
  misc_feature 1..42: note = source = /note="Description of Artificial Sequence: Syntheticoligonucleotide"
  source 1..42: mol_type = other DNA
agtagcgcgagcacagctaaggccagttttagtactctgtaa

SEQ ID NO: 1164 - DNA, 42 bp, synthetic construct
  misc_feature 1..42: note = source = /note="Description of Artificial Sequence: Syntheticoligonucleotide"
  source 1..42: mol_type = other DNA
ctggatagcctccaggccagaaagagttttagtactctgtaa

SEQ ID NO: 1165 - DNA, 42 bp, synthetic construct
  misc_feature 1..42: note = source = /note="Description of Artificial Sequence: Syntheticoligonucleotide"
  source 1..42: mol_type = other DNA
ctttctggcctggaggctatccagcgttttagtactctgtaa

SEQ ID NO: 1166 - DNA, 37 bp, synthetic construct
  misc_feature 1..37: note = source = /note="Description of Artificial Sequence: Syntheticoligonucleotide"
  source 1..37: mol_type = other DNA
gtctctcagctggtacacgggttttagtactctgtaa

SEQ ID NO: 1167 - DNA, 37 bp, synthetic construct
  misc_feature 1..37: note = source = /note="Description of Artificial Sequence: Syntheticoligonucleotide"
  source 1..37: mol_type = other DNA
gacagacttgtcactggattgttttagtactctgtaa

SEQ ID NO: 1168 - DNA, 42 bp, synthetic construct
  misc_feature 1..42: note = source = /note="Description of Artificial Sequence: Syntheticoligonucleotide"
  source 1..42: mol_type = other DNA
ttagagtctctcagctggtacacgggttttagtactctgtaa

SEQ ID NO: 1169 - DNA, 42 bp, synthetic construct
  misc_feature 1..42: note = source = /note="Description of Artificial Sequence: Syntheticoligonucleotide"
  source 1..42: mol_type = other DNA
aggcagacagacttgtcactggattgttttagtactctgtaa

SEQ ID NO: 1170 - DNA, 64 bp, synthetic construct
  misc_feature 1..64: note = source = /note="Description of Artificial Sequence: Syntheticoligonucleotide"
  source 1..64: mol_type = other DNA
ttacagaatctactaaaacaaggcaaaatgccgtgtttatctcgtcaacttgttggcgagattt

SEQ ID NO: 1171 - DNA, 64 bp, synthetic construct
  misc_feature 1..64: note = source = /note="Description of Artificial Sequence: Syntheticoligonucleotide"
  source 1..64: mol_type = other DNA
ttacagaatctactaaaacaagactatatatcgtgtttatcccatcaatttattgatgggattt

SEQ ID NO: 1172 - DNA, 53 bp, synthetic construct
  misc_feature 1..53: note = source = /note="Description of Artificial Sequence: Syntheticprimer"
  source 1..53: mol_type = other DNA
tcgtcggcagcgtcagatgtgtataagagacaggggcaaagagggaaatgaga

SEQ ID NO: 1173 - DNA, 54 bp, synthetic construct
  misc_feature 1..54: note = source = /note="Description of Artificial Sequence: Syntheticprimer"
  source 1..54: mol_type = other DNA
gtctcgtgggctcggagatgtgtataagagacaggaacctggccattcctgaag

SEQ ID NO: 1174 - DNA, 51 bp, synthetic construct
  misc_feature 1..51: note = source = /note="Description of Artificial Sequence: Syntheticprimer"
  source 1..51: mol_type = other DNA
tcgtcggcagcgtcagatgtgtataagagacagcgggcattcctgaagctg

SEQ ID NO: 1175 - DNA, 53 bp, synthetic construct
  misc_feature 1..53: note = source = /note="Description of Artificial Sequence: Syntheticprimer"
  source 1..53: mol_type = other DNA
gtctcgtgggctcggagatgtgtataagagacaggtaggccaaaggtctcccc

SEQ ID NO: 1176 - DNA, 20 bp, synthetic construct
  misc_feature 1..20: note = source = /note="Description of Artificial Sequence: Syntheticoligonucleotide"
  source 1..20: mol_type = other DNA
ggggcacagatgagaaactc

SEQ ID NO: 1177 - DNA, 20 bp, synthetic construct
  misc_feature 1..20: note = source = /note="Description of Artificial Sequence: Syntheticoligonucleotide"
  source 1..20: mol_type = other DNA
gtacaaacggcagaagctgg

SEQ ID NO: 1178 - DNA, 20 bp, synthetic construct
  misc_feature 1..20: note = source = /note="Description of Artificial Sequence: Syntheticoligonucleotide"
  source 1..20: mol_type = other DNA
ggcagaagctggaggaggaa

SEQ ID NO: 1179 - DNA, 20 bp, synthetic construct
  misc_feature 1..20: note = source = /note="Description of Artificial Sequence: Syntheticoligonucleotide"
  source 1..20: mol_type = other DNA
gggcaaccacaaacccacga

SEQ ID NO: 1180 - DNA, 20 bp, synthetic construct
  misc_feature 1..20: note = source = /note="Description of Artificial Sequence: Syntheticoligonucleotide"
  source 1..20: mol_type = other DNA
gctcccatcacatcaaccgg

SEQ ID NO: 1181 - DNA, 20 bp, synthetic construct
  misc_feature 1..20: note = source = /note="Description of Artificial Sequence: Syntheticoligonucleotide"
  source 1..20: mol_type = other DNA
ggcagagtgctgcttgctgc

SEQ ID NO: 1182 - DNA, 20 bp, synthetic construct
  misc_feature 1..20: note = source = /note="Description of Artificial Sequence: Syntheticoligonucleotide"
  source 1..20: mol_type = other DNA
gcccctgcgtgggcccaagc

SEQ ID NO: 1183 - DNA, 20 bp, synthetic construct
  misc_feature 1..20: note = source = /note="Description of Artificial Sequence: Syntheticoligonucleotide"
  source 1..20: mol_type = other DNA
gagtggccagagtccagctt

SEQ ID NO: 1184 - DNA, 20 bp, synthetic construct
  misc_feature 1..20: note = source = /note="Description of Artificial Sequence: Syntheticoligonucleotide"
  source 1..20: mol_type = other DNA
aacctgtgaaaatgctcccc

SEQ ID NO: 1185 - DNA, 20 bp, synthetic construct
  misc_feature 1..20: note = source = /note="Description of Artificial Sequence: Syntheticoligonucleotide"
  source 1..20: mol_type = other DNA
tgttctgccagaaattgtgg

That which is claimed:

1. A nucleic acid molecule comprising a polynucleotide encoding an RNA-guided nuclease (RGN) polypeptide, wherein said polynucleotide comprises a nucleotide sequence encoding an RGN polypeptide comprising an amino acid sequence having at least 90% sequence identity to SEQ ID NO: 83,
   wherein said RGN polypeptide is capable of binding a target DNA sequence in an RNA-guided sequence specific manner when bound to a guide RNA (gRNA) capable of hybridizing to said target DNA sequence, and
   wherein said polynucleotide encoding an RGN polypeptide is operably linked to a promoter heterologous to said polynucleotide.

2. The nucleic acid molecule of claim 1, wherein said RGN polypeptide comprises the amino acid sequence set forth as SEQ ID NO: 83.

3. The nucleic acid molecule of claim 1, wherein said RGN polypeptide is nuclease inactive or is a nickase.

4. The nucleic acid molecule of claim 1, wherein the nucleic acid molecule further comprises a polynucleotide encoding a base-editing polypeptide operably linked to the polynucleotide encoding the RGN polypeptide.

5. The nucleic acid molecule of claim 1, wherein the RGN polypeptide comprises one or more nuclear localization signals.

6. The nucleic acid molecule of claim 1, wherein the polynucleotide encoding the RGN polypeptide is codon optimized for expression in a eukaryotic cell.

7. A vector comprising the nucleic acid molecule of claim 1.

8. The vector of claim 7, further comprising at least one nucleotide sequence encoding said gRNA capable of hybridizing to said target DNA sequence.

9. The vector of claim 7, wherein the gRNA is selected from:
   a) a gRNA comprising:
      i) a CRISPR RNA comprising a CRISPR repeat sequence having at least 90% sequence identity to SEQ ID NO: 84; and
      ii) a tracrRNA having at least 90% sequence identity to SEQ ID NO: 85; or
   b) a gRNA comprising:
      i) a CRISPR RNA comprising a CRISPR repeat sequence having at least 90% sequence identity to SEQ ID NO: 84; and
      ii) a tracrRNA having at least 90% sequence identity to SEQ ID NO: 78.

10. A cell comprising the nucleic acid molecule of claim 1.

11. A method for cleaving and/or modifying a target DNA sequence of a DNA molecule, comprising contacting the DNA molecule with:
    a) an RNA-guided nuclease (RGN) polypeptide encoded by the polynucleotide of the nucleic acid molecule of claim 1; and
    b) one or more guide RNAs capable of targeting the RGN polypeptide of (a) to the target DNA sequence;
    wherein the one or more guide RNAs hybridize to the target DNA sequence, thereby directing said RGN polypeptide to bind to said target DNA sequence and cleavage and/or modification of said target DNA sequence occurs.

12. The method of claim 11, wherein cleavage by said RGN polypeptide generates a double-stranded break.

13. The method of claim 11, wherein cleavage by said RGN polypeptide generates a single-stranded break.

14. The method of claim 11, wherein said modified target DNA sequence comprises deletion of at least one nucleotide from the target DNA sequence.

15. The method of claim 11, wherein said modified target DNA sequence comprises mutation of at least one nucleotide in the target DNA sequence.

16. The method of claim 11, wherein said RGN comprises the amino acid sequence set forth as SEQ ID NO: 83.

17. The nucleic acid molecule of claim 1, wherein said RGN polypeptide comprises an amino acid sequence having at least 95% identity to SEQ ID NO:83.

18. The method of claim 11, wherein said RGN polypeptide comprises an amino acid sequence having at least 95% identity to SEQ ID NO:83.

* * * * *